United States Patent 12,508,308 (INFLUENZA mRNA VACCINES) - sequence listing, part 42

SEQ ID NO: 161374 - RNA, 1701 nt, Artificial Sequence
  derived and/or modified sequence opt4 from hemagglutinin__InfluenzaA__AFJ77858
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcacccagagaagccagcagaccgugauccccaacaucggcagcagacccagagugagagacauccccagcagaaucagcaucuacuggaccaucgugaagcccggcgacaugcugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacaagcugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccuguucugcguggcccugcugggcuucaucaugugggccugccagaagggcaacaucagaugcaacaucugcaucuga

SEQ ID NO: 161375 - RNA, 1701 nt, Artificial Sequence
  derived and/or modified sequence opt4 from hemagglutinin__InfluenzaA__AFJ77869
augaagaccaucaucgccuucagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161376 - RNA, 1701 nt, Artificial Sequence
  derived and/or modified sequence opt4 from hemagglutinin__InfluenzaA__AFJ77880
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161377 - RNA, 1701 nt, Artificial Sequence
  derived and/or modified sequence opt4 from hemagglutinin__InfluenzaA__AFJ77902
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucggccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacaugcugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161378 - RNA, 1701 nt, Artificial Sequence
  derived and/or modified sequence opt4 from hemagglutinin__InfluenzaA__AFJ77913
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcaggacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacaugcugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161379 - RNA, 1701 nt, Artificial Sequence; identical to SEQ ID NO: 153633
  derived and/or modified sequence opt4 from hemagglutinin__InfluenzaA__AFJ77924

SEQ ID NO: 161380 - RNA, 1701 nt, Artificial Sequence
  derived and/or modified sequence opt4 from hemagglutinin__InfluenzaA__AFJ77935
augaagaccaucaucgcccugagcuacauccugugccugguguucgcccagaagcugcccggcaacgacaacagcaccgccacccugugccugggccaccacgccgugcccaacggcaccguggugaagaccaucaccaacgaccagaucgaggugaccaacgccaccgagcuggugcagagcagcagcaccggcggcaucugcgacagcccccaccagauccuggacggcgagaacugcacccugauggacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaccuucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161381 - RNA, 1701 nt, Artificial Sequence
  derived and/or modified sequence opt4 from hemagglutinin__InfluenzaA__AFJ77946
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacaugcugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacaucaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggaucaucuggaucagcuucgccaucagcugcuuccugcugugcguggcccugcugggcuucaucaugugggccugccagaagggcaacaucagaugcaacaucugcaucuga

SEQ ID NO: 161382 - RNA, 1701 nt, Artificial Sequence; identical to SEQ ID NO: 154273
  derived and/or modified sequence opt4 from hemagglutinin__InfluenzaA__AFJ77957

SEQ ID NO: 161383 - RNA, 1701 nt, Artificial Sequence; identical to SEQ ID NO: 153150
  derived and/or modified sequence opt4 from hemagglutinin__InfluenzaA__AFJ77968

SEQ ID NO: 161384 - RNA, 1701 nt, Artificial Sequence
  derived and/or modified sequence opt4 from hemagglutinin__InfluenzaA__AFJ77979
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugagaagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161385 - RNA, 1701 nt, Artificial Sequence
  derived and/or modified sequence opt4 from hemagglutinin__InfluenzaA__AFJ77990
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacgaguacagagacgaggcccugaacaacagauuccagaucaagggcguggagcugaagagcggcuacaaggacuggauccuguggaucagcuucgccaucagcugcuuccugcugugcgugacccugcugggcuucaucaugugggccugccagaagggcaacaucagaugcaacaucugcaucuga

SEQ ID NO: 161386 - RNA, 1701 nt, Artificial Sequence
  derived and/or modified sequence opt4 from hemagglutinin__InfluenzaA__AFJ78001
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcaagaacugcacccugaucgacgcccugcugggcgacccccagugcgacgacuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcgugacccugcugggcuucaucaugugggccugccagaagggcaacaucagaugcaacaucugcaucuga

SEQ ID NO: 161387 - RNA, 1701 nt, Artificial Sequence
  derived and/or modified sequence opt4 from hemagglutinin__InfluenzaA__AFJ78012
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161388 - RNA, 1701 nt, Artificial Sequence
  derived and/or modified sequence opt4 from hemagglutinin__InfluenzaA__AFJ78023
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaaagagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161389 - RNA, 1701 nt, Artificial Sequence; identical to SEQ ID NO: 153150
  derived and/or modified sequence opt4 from hemagglutinin__InfluenzaA__AFJ78034

SEQ ID NO: 161390 - RNA, 1701 nt, Artificial Sequence
  derived and/or modified sequence opt4 from hemagglutinin__InfluenzaA__AFJ78045
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaugggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucaagugcaacaucugcaucuga

SEQ ID NO: 161391 - RNA, 1701 nt, Artificial Sequence; identical to SEQ ID NO: 153150
  derived and/or modified sequence opt4 from hemagglutinin__InfluenzaA__AFJ78056

SEQ ID NO: 161392 - RNA, 1701 nt, Artificial Sequence
  derived and/or modified sequence opt4 from hemagglutinin__InfluenzaA__AFJ78067
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcagaagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161393 - RNA, 1701 nt, Artificial Sequence
  derived and/or modified sequence opt4 from hemagglutinin__InfluenzaA__AFJ78078
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161394 - RNA, 1701 nt, Artificial Sequence; identical to SEQ ID NO: 161317
  derived and/or modified sequence opt4 from hemagglutinin__InfluenzaA__AFJ78089

SEQ ID NO: 161395 - RNA, 1701 nt, Artificial Sequence; identical to SEQ ID NO: 154348
  derived and/or modified sequence opt4 from hemagglutinin__InfluenzaA__AFJ78100

SEQ ID NO: 161396 - RNA, 1701 nt, Artificial Sequence
  derived and/or modified sequence opt4 from hemagglutinin__InfluenzaA__AFJ78111
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaacuucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161397 - RNA, 1701 nt, Artificial Sequence
  derived and/or modified sequence opt4 from hemagglutinin__InfluenzaA__AFJ78122
augaagaccaucaucgcccugagcuacauccugugccugaucuucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcagaagcagcaucaugagaagcgacgcccccaucgacaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucagaaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161398 - RNA, 1701 nt, Artificial Sequence
  derived and/or modified sequence opt4 from hemagglutinin__InfluenzaA__AFJ78144
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcagcugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagguggaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161399 - RNA, 1701 nt, Artificial Sequence; identical to SEQ ID NO: 161398
  derived and/or modified sequence opt4 from hemagglutinin__InfluenzaA__AFJ78155

SEQ ID NO: 161400 - RNA, 1701 nt, Artificial Sequence
  derived and/or modified sequence opt4 from hemagglutinin__InfluenzaA__AFJ78166
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161401 - RNA, 1701 nt, Artificial Sequence; identical to SEQ ID NO: 154249
  derived and/or modified sequence opt4 from hemagglutinin__InfluenzaA__AFJ78177

SEQ ID NO: 161402 - RNA, 1701 nt, Artificial Sequence
  derived and/or modified sequence opt4 from hemagglutinin__InfluenzaA__AFJ78188
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161403 - RNA, 1701 nt, Artificial Sequence
  derived and/or modified sequence opt4 from hemagglutinin__InfluenzaA__AFJ78210
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcaucgagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161404 - RNA, 1701 nt, Artificial Sequence; identical to SEQ ID NO: 161328
  derived and/or modified sequence opt4 from hemagglutinin__InfluenzaA__AFJ78221

SEQ ID NO: 161405 - RNA, 1701 nt, Artificial Sequence
  derived and/or modified sequence opt4 from hemagglutinin__InfluenzaA__AFJ78232
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcaagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucggcaagaccaacgagaaguuccaccagaucgagaacgaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161406 - RNA, 1701 nt, Artificial Sequence
  derived and/or modified sequence opt4 from hemagglutinin__InfluenzaA__AFJ78243
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucuuccuguacgccaaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccgugggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacacaagaacagcgagggcaccggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161407 - RNA, 1701 nt, Artificial Sequence
  derived and/or modified sequence opt4 from hemagglutinin__InfluenzaA__AFJ78254
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagguggaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161408 - RNA, 1701 nt, Artificial Sequence; identical to SEQ ID NO: 161407
  derived and/or modified sequence opt4 from hemagglutinin__InfluenzaA__AFJ78265

SEQ ID NO: 161409 - RNA, 1701 nt, Artificial Sequence
  derived and/or modified sequence opt4 from hemagglutinin__InfluenzaA__AFJ78276
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagguggaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161410 - RNA, 1701 nt, Artificial Sequence
  derived and/or modified sequence opt4 from hemagglutinin__InfluenzaA__AFJ78287
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugauggacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccccuacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161411 - RNA, 1698 nt, Artificial Sequence
  derived and/or modified sequence opt4 from hemagglutinin__InfluenzaA__AFJ78309
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccaucaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161412 - RNA, 1701 nt, Artificial Sequence
  derived and/or modified sequence opt4 from hemagglutinin__InfluenzaA__AFJ78320
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161413 - RNA, 1698 nt, Artificial Sequence
  derived and/or modified sequence opt4 from hemagglutinin__InfluenzaA__AFJ78331
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161414 - RNA, 1698 nt, Artificial Sequence; identical to SEQ ID NO: 161413
  derived and/or modified sequence opt4 from hemagglutinin__InfluenzaA__AFJ78342

SEQ ID NO: 161415 - RNA, 1698 nt, Artificial Sequence; identical to SEQ ID NO: 161413
  derived and/or modified sequence opt4 from hemagglutinin__InfluenzaA__AFJ78353

SEQ ID NO: 161416 - RNA, 1698 nt, Artificial Sequence
  derived and/or modified sequence opt4 from hemagglutinin__InfluenzaA__AFJ78364
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacaacagaagauucacccccgagaucgccaagagacccaaggugagaaaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccaucaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161417 - RNA, 1698 nt, Artificial Sequence
  derived and/or modified sequence opt4 from hemagglutinin__InfluenzaA__AFJ78375
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcaucaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucgugaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcaucaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161418 - RNA, 1698 nt, Artificial Sequence; identical to SEQ ID NO: 153905
  derived and/or modified sequence opt4 from hemagglutinin__InfluenzaA__AFJ78386

SEQ ID NO: 161419 - RNA, 1698 nt, Artificial Sequence; identical to SEQ ID NO: 153905
  derived and/or modified sequence opt4 from hemagglutinin__InfluenzaA__AFJ78397

SEQ ID NO: 161420 - RNA, 1698 nt, Artificial Sequence; identical to SEQ ID NO: 160597
  derived and/or modified sequence opt4 from hemagglutinin__InfluenzaA__AFJ78408

SEQ ID NO: 161421 - RNA, 1698 nt, Artificial Sequence
  derived and/or modified sequence opt4 from hemagglutinin__InfluenzaA__AFJ78419
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccgugaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161422 - RNA, 1698 nt, Artificial Sequence
  derived and/or modified sequence opt4 from hemagglutinin__InfluenzaA__AFJ78430
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcagagagagcuggagcuacaucguggagaaccccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaaaguucacccccgagaucgccaagagacccaaggugagagaccaggagggcagaaucaacuacuacuggacccugcugggccccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161423 - RNA, 1698 nt, Artificial Sequence
  derived and/or modified sequence opt4 from hemagglutinin__InfluenzaA__AFJ78441
augaaggugaagcugauggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcagagagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccguggacaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161424 - RNA, 1698 nt, Artificial Sequence
  derived and/or modified sequence opt4 from hemagglutinin__InfluenzaA__AFJ78452
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucauccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161425 - RNA, 1698 nt, Artificial Sequence
  derived and/or modified sequence opt4 from hemagglutinin__InfluenzaA__AFJ78463
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacaagaaccugcuguggcugaccggcaagaacggccuguaccccaaccugggcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucauccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161426 - RNA, 1698 nt, Artificial Sequence
  derived and/or modified sequence opt4 from hemagglutinin__InfluenzaA__AFJ78474
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcagagagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagcuacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161427 - RNA, 1698 nt, Artificial Sequence
  derived and/or modified sequence opt4 from hemagglutinin__InfluenzaA__AFJ78485
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcagagagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccaccaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggaggacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161428 - RNA, 1698 nt, Artificial Sequence
  derived and/or modified sequence opt4 from hemagglutinin__InfluenzaA__AFJ78496
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcagagagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccaccaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcggccagagagcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161429 - RNA, 1698 nt, Artificial Sequence
  derived and/or modified sequence opt4 from hemagglutinin__InfluenzaA__AFJ78518
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcagagagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccaccaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161430 - RNA, 1698 nt, Artificial Sequence
  derived and/or modified sequence opt4 from hemagglutinin__InfluenzaA__AFJ78529
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacaaccacaacggcaagcugugccugcugaagggcaucgccccccugcagcugggcaacugcagcguggccggcuggauccugggcaaccccgagugcgagcugcugaucagcaaggagagcuggagcuacaucguggagagacccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagaugacccuguaccacaaggagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacguguggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugagcagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161431 - RNA, 1698 nt, Artificial Sequence; identical to SEQ ID NO: 161430
  derived and/or modified sequence opt4 from hemagglutinin__InfluenzaA__AFJ78540

SEQ ID NO: 161432 - RNA, 1698 nt, Artificial Sequence; identical to SEQ ID NO: 161430
  derived and/or modified sequence opt4 from hemagglutinin__InfluenzaA__AFJ78551

SEQ ID NO: 161433 - RNA, 1698 nt, Artificial Sequence
  derived and/or modified sequence opt4 from hemagglutinin__InfluenzaA__AFJ78562
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacaaccacaacggcaagcugugccugcugaagggcaucgccccccugcagcugggcaacugcagcguggccggcuggauccugggcaaccccgagugcgagcugcugaucagcaaggagagcuggagcuacaucguggagagacccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacaagaaccugcuguggcugaccggcaagaacggccuguaccccacccugagcaagagcuacgccaacaacaaggagaaggaggugcuggugcuguggggcgugcaccacccccccaacaucggcgaccagaugacccuguaccacaaggagaacgccuacgugagcguggugagcagccacuacagcagaaaguucacccccgagaucgccaagagacugaaggugagagaccaggagggcagaaucaacuacuacuggacccugcuggagcccggcgacaccaucaucuucgaggccaacggcaaccugaucgcccccagauacgccuucgcccugagcagaggccugggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacguguggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugagcagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161434 - RNA, 1698 nt, Artificial Sequence
  derived and/or modified sequence opt4 from hemagglutinin__InfluenzaA__AFJ78573
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacaaccacaacggcaagcugugccugcugaagggcaucgccccccugcagcugggcaacugcagcguggccggcuggauccugggcaaccccgagugcgagcugcugaucagcaaggagagcuggagcuacaucguggagagacccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagaugacccuguaccacaaggagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgccagcauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacguguggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggaggccaagcugagcagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161435 - RNA, 1698 nt, Artificial Sequence
  derived and/or modified sequence opt4 from hemagglutinin__InfluenzaA__AFJ78584
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccagaaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccguggccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161436 - RNA, 1698 nt, Artificial Sequence
  derived and/or modified sequence opt4 from hemagglutinin__InfluenzaA__AFJ78595
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacagagagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161437 - RNA, 1698 nt, Artificial Sequence
  derived and/or modified sequence opt4 from hemagglutinin__InfluenzaA__AFJ78617
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacgacggcgagagcagcuucuacagaaaccugcuguggcugaccggcaagaacggccuguaccccaaccugagcaagagcuacgccaacaacaaggagaaggaggugcuggugcuguggggcgugcaccacccccccagcaucagcgaccagaagacccuguaccacaccgagaacgcccacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugagcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161438 - RNA, 1698 nt, Artificial Sequence
  derived and/or modified sequence opt4 from hemagglutinin__InfluenzaA__AFJ78628
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacaaccacaacggcaagcugugccugcugaagggcaucgccccccugcagcugggcaacugcagcguggccggcuggauccugggcaaccccgagugcgagcugcugaucagcaaggagagcuggagcuacaucguggagagacccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcaaccagaugacccuguaccacaaggagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacguguggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugagcagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161439 - RNA, 1698 nt, Artificial Sequence
  derived and/or modified sequence opt4 from hemagglutinin__InfluenzaA__AFJ78639
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccagcaucagcaaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161440 - RNA, 1698 nt, Artificial Sequence; identical to SEQ ID NO: 161439
  derived and/or modified sequence opt4 from hemagglutinin__InfluenzaA__AFJ78650

SEQ ID NO: 161441 - RNA, 1701 nt, Artificial Sequence; identical to SEQ ID NO: 155189
  derived and/or modified sequence opt4 from hemagglutinin__InfluenzaA__AFJ78661

SEQ ID NO: 161442 - RNA, 1701 nt, Artificial Sequence
  derived and/or modified sequence opt4 from hemagglutinin__InfluenzaA__AFJ78681
augaaggccauccugguggugcugcuguacaccuucgccaccgugaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161443 - RNA, 1701 nt, Artificial Sequence; identical to SEQ ID NO: 155189
  derived and/or modified sequence opt4 from hemagglutinin__InfluenzaA__AFJ78691

SEQ ID NO: 161444 - RNA, 1701 nt, Artificial Sequence; identical to SEQ ID NO: 155189
  derived and/or modified sequence opt4 from hemagglutinin__InfluenzaA__AFJ78701

SEQ ID NO: 161445 - RNA, 1701 nt, Artificial Sequence; identical to SEQ ID NO: 159717
  derived and/or modified sequence opt4 from hemagglutinin__InfluenzaA__AFJ78711

SEQ ID NO: 161446 - RNA, 1701 nt, Artificial Sequence; identical to SEQ ID NO: 155189
  derived and/or modified sequence opt4 from hemagglutinin__InfluenzaA__AFJ78721

SEQ ID NO: 161447 - RNA, 1701 nt, Artificial Sequence
  derived and/or modified sequence opt4 from hemagglutinin__InfluenzaA__AFJ78731
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcagcaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161448 - RNA, 1701 nt, Artificial Sequence; identical to SEQ ID NO: 156353
  derived and/or modified sequence opt4 from hemagglutinin__InfluenzaA__AFJ78741

SEQ ID NO: 161449 - RNA, 1701 nt, Artificial Sequence; identical to SEQ ID NO: 155189
  derived and/or modified sequence opt4 from hemagglutinin__InfluenzaA__AFJ78751

SEQ ID NO: 161450 - RNA, 1701 nt, Artificial Sequence; identical to SEQ ID NO: 155189
  derived and/or modified sequence opt4 from hemagglutinin__InfluenzaA__AFJ78761

SEQ ID NO: 161451 - RNA, 1701 nt, Artificial Sequence; identical to SEQ ID NO: 155189
  derived and/or modified sequence opt4 from hemagglutinin__InfluenzaA__AFJ78771

SEQ ID NO: 161452 - RNA, 1701 nt, Artificial Sequence; identical to SEQ ID NO: 155189
  derived and/or modified sequence opt4 from hemagglutinin__InfluenzaA__AFJ78781

SEQ ID NO: 161453 - RNA, 1701 nt, Artificial Sequence; identical to SEQ ID NO: 155189
  derived and/or modified sequence opt4 from hemagglutinin__InfluenzaA__AFJ78791

SEQ ID NO: 161454 - RNA, 1701 nt, Artificial Sequence; identical to SEQ ID NO: 155189
  derived and/or modified sequence opt4 from hemagglutinin__InfluenzaA__AFJ78801

SEQ ID NO: 161455 - RNA, 1701 nt, Artificial Sequence; identical to SEQ ID NO: 156050
  derived and/or modified sequence opt4 from hemagglutinin__InfluenzaA__AFJ78811

SEQ ID NO: 161456 - RNA, 1701 nt, Artificial Sequence; identical to SEQ ID NO: 155189
  derived and/or modified sequence opt4 from hemagglutinin__InfluenzaA__AFJ78821

SEQ ID NO: 161457 - RNA, 1701 nt, Artificial Sequence; identical to SEQ ID NO: 155189
  derived and/or modified sequence opt4 from hemagglutinin__InfluenzaA__AFJ78831

SEQ ID NO: 161458 - RNA, 1701 nt, Artificial Sequence; identical to SEQ ID NO: 156387
  derived and/or modified sequence opt4 from hemagglutinin__InfluenzaA__AFJ78841

SEQ ID NO: 161459 - RNA, 1701 nt, Artificial Sequence; identical to SEQ ID NO: 155189
  derived and/or modified sequence opt4 from hemagglutinin__InfluenzaA__AFJ78851

SEQ ID NO: 161460 - RNA, 1701 nt, Artificial Sequence
  derived and/or modified sequence opt4 from hemagglutinin__InfluenzaA__AFJ78861
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcagacugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161461 - RNA, 1701 nt, Artificial Sequence
  derived and/or modified sequence opt4 from hemagglutinin__InfluenzaA__AFJ78881
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccagcagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucaacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 161462 - RNA, 1701 nt, Artificial Sequence; identical to SEQ ID NO: 155189
  derived and/or modified sequence opt4 from hemagglutinin__InfluenzaA__AFJ78891

SEQ ID NO: 161463 - RNA, 1701 nt, Artificial Sequence; identical to SEQ ID NO: 155189
  derived and/or modified sequence opt4 from hemagglutinin__InfluenzaA__AFJ78901

SEQ ID NO: 161464 - RNA, 1701 nt, Artificial Sequence; identical to SEQ ID NO: 155189
  derived and/or modified sequence opt4 from hemagglutinin__InfluenzaA__AFJ78911

SEQ ID NO: 161465 - RNA, 1701 nt, Artificial Sequence; identical to SEQ ID NO: 155189
  derived and/or modified sequence opt4 from hemagglutinin__InfluenzaA__AFJ78921

SEQ ID NO: 161466 - RNA, 1701 nt, Artificial Sequence
  derived and/or modified sequence opt4 from hemagglutinin__InfluenzaA__AFJ97567
augaaggccauccugguggugcugcuguacaccuucgccaccgccaacgccgacacccugugcaucggcuaccacgccaacaacagcaccgacaccguggacaccgugcuggagaagaacgugaccgugacccacagcguggaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaacaagagcuacaucaacgacaagggcaaggaggugcuggugcuguggggcauccaccaccccagcaccagcaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccaagggcgccaucaacaccagcuuccccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161467 - RNA, 1701 nt, Artificial Sequence; identical to SEQ ID NO: 155189
  derived and/or modified sequence opt4 from hemagglutinin__InfluenzaA__AFK14115

SEQ ID NO: 161468 - RNA, 1701 nt, Artificial Sequence; identical to SEQ ID NO: 155189
  derived and/or modified sequence opt4 from hemagglutinin__InfluenzaA__AFK14131

SEQ ID NO: 161469 - RNA, 1701 nt, Artificial Sequence; identical to SEQ ID NO: 156871
  derived and/or modified sequence opt4 from hemagglutinin__InfluenzaA__AFK14139

SEQ ID NO: 161470 - RNA, 1701 nt, Artificial Sequence
  derived and/or modified sequence opt4 from hemagglutinin__InfluenzaA__AFK14148
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161471 - RNA, 1701 nt, Artificial Sequence; identical to SEQ ID NO: 156816
  derived and/or modified sequence opt4 from hemagglutinin__InfluenzaA__AFK14157

SEQ ID NO: 161472 - RNA, 1701 nt, Artificial Sequence; identical to SEQ ID NO: 155189
  derived and/or modified sequence opt4 from hemagglutinin__InfluenzaA__AFK14166

SEQ ID NO: 161473 - RNA, 1701 nt, Artificial Sequence; identical to SEQ ID NO: 156517
  derived and/or modified sequence opt4 from hemagglutinin__InfluenzaA__AFK14175

SEQ ID NO: 161474 - RNA, 1701 nt, Artificial Sequence; identical to SEQ ID NO: 158094
  derived and/or modified sequence opt4 from hemagglutinin__InfluenzaA__AFK14184

SEQ ID NO: 161475 - RNA, 1701 nt, Artificial Sequence; identical to SEQ ID NO: 155542
  derived and/or modified sequence opt4 from hemagglutinin__InfluenzaA__AFK14193

SEQ ID NO: 161476 - RNA, 1701 nt, Artificial Sequence; identical to SEQ ID NO: 156786
  derived and/or modified sequence opt4 from hemagglutinin__InfluenzaA__AFK14202

SEQ ID NO: 161477 - RNA, 1701 nt, Artificial Sequence; identical to SEQ ID NO: 155542
  derived and/or modified sequence opt4 from hemagglutinin__InfluenzaA__AFK14211

SEQ ID NO: 161478 - RNA, 1701 nt, Artificial Sequence
  derived and/or modified sequence opt4 from hemagglutinin__InfluenzaA__AFK14220
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgccagcagcuucgagagauacgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161479 - RNA, 1701 nt, Artificial Sequence; identical to SEQ ID NO: 156816
  derived and/or modified sequence opt4 from hemagglutinin__InfluenzaA__AFK14229

SEQ ID NO: 161480 - RNA, 1701 nt, Artificial Sequence; identical to SEQ ID NO: 159954
  derived and/or modified sequence opt4 from hemagglutinin__InfluenzaA__AFK14238

SEQ ID NO: 161481 - RNA, 1701 nt, Artificial Sequence
  derived and/or modified sequence opt4 from hemagglutinin__InfluenzaA__AFK14247
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaugaacaccagccugcccuuccagaacauccaccccaucaccaucggcaagugccccaaguacgugaagagcaccaagcugagaauggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161482 - RNA, 1701 nt, Artificial Sequence
  derived and/or modified sequence opt4 from hemagglutinin__InfluenzaA__AFK14272
augaaggccauccugaucgugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugaccggcguggccccccugcaccugggcaagugcgacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161483 - RNA, 1701 nt, Artificial Sequence; identical to SEQ ID NO: 155542
  derived and/or modified sequence opt4 from hemagglutinin__InfluenzaA__AFK14314

SEQ ID NO: 161484 - RNA, 1701 nt, Artificial Sequence
  derived and/or modified sequence opt4 from hemagglutinin__InfluenzaA__AFK14323
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161485 - RNA, 1701 nt, Artificial Sequence; identical to SEQ ID NO: 159954
  derived and/or modified sequence opt4 from hemagglutinin__InfluenzaA__AFK14332

SEQ ID NO: 161486 - RNA, 1701 nt, Artificial Sequence
  derived and/or modified sequence opt4 from hemagglutinin__InfluenzaA__AFK14341
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagaagacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161487 - RNA, 1701 nt, Artificial Sequence; identical to SEQ ID NO: 156609
  derived and/or modified sequence opt4 from hemagglutinin__InfluenzaA__AFK14350

SEQ ID NO: 161488 - RNA, 1701 nt, Artificial Sequence
  derived and/or modified sequence opt4 from hemagglutinin__InfluenzaA__AFK14358
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcgccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagaagacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161489 - RNA, 1701 nt, Artificial Sequence
  derived and/or modified sequence opt4 from hemagglutinin__InfluenzaA__AFK14395
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgagaacggcaugugcugccccagagacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 161490 - RNA, 1701 nt, Artificial Sequence
  derived and/or modified sequence opt4 from hemagglutinin__InfluenzaA__AFK14431
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuuccuggacuacgaggagcugagaaagcagcugagcagcgugagcagcuucgagagaguggagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161491 - RNA, 1701 nt, Artificial Sequence; identical to SEQ ID NO: 155189
  derived and/or modified sequence opt4 from hemagglutinin__InfluenzaA__AFK14456

SEQ ID NO: 161492 - RNA, 1701 nt, Artificial Sequence; identical to SEQ ID NO: 155189
  derived and/or modified sequence opt4 from hemagglutinin__InfluenzaA__AFK14465

SEQ ID NO: 161493 - RNA, 1701 nt, Artificial Sequence
  derived and/or modified sequence opt4 from hemagglutinin__InfluenzaA__AFK14536
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccuacagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161494 - RNA, 1701 nt, Artificial Sequence; identical to SEQ ID NO: 155189
  derived and/or modified sequence opt4 from hemagglutinin__InfluenzaA__AFK14571

SEQ ID NO: 161495 - RNA, 1701 nt, Artificial Sequence; identical to SEQ ID NO: 159698
  derived and/or modified sequence opt4 from hemagglutinin__InfluenzaA__AFK14586

SEQ ID NO: 161496 - RNA, 1701 nt, Artificial Sequence
  derived and/or modified sequence opt4 from hemagglutinin__InfluenzaA__AFK14595
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugaagggcguggccccccugcaccugggcaagugcaacaucgccggcuggauccugggcaaccccaagugcgagagccugagcaccgccagcagcuggagcuacaucggcgagaccagcagcagcaacaacggcaccugcuaccccggcaacuucaucgacuucgaggagcugaagaagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161497 - RNA, 1701 nt, Artificial Sequence; identical to SEQ ID NO: 159698
  derived and/or modified sequence opt4 from hemagglutinin__InfluenzaA__AFK14612

SEQ ID NO: 161498 - RNA, 1701 nt, Artificial Sequence; identical to SEQ ID NO: 155189
  derived and/or modified sequence opt4 from hemagglutinin__InfluenzaA__AFK14621

SEQ ID NO: 161499 - RNA, 1701 nt, Artificial Sequence
  derived and/or modified sequence opt4 from hemagglutinin__InfluenzaA__AFK14630
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagagccgaccugcagagcaucaaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161500 - RNA, 1701 nt, Artificial Sequence
  derived and/or modified sequence opt4 from hemagglutinin__InfluenzaA__AFK14639
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaggccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161501 - RNA, 1701 nt, Artificial Sequence; identical to SEQ ID NO: 155189
  derived and/or modified sequence opt4 from hemagglutinin__InfluenzaA__AFK14661

SEQ ID NO: 161502 - RNA, 1701 nt, Artificial Sequence; identical to SEQ ID NO: 159698
  derived and/or modified sequence opt4 from hemagglutinin__InfluenzaA__AFK14670

SEQ ID NO: 161503 - RNA, 1701 nt, Artificial Sequence; identical to SEQ ID NO: 159698
  derived and/or modified sequence opt4 from hemagglutinin__InfluenzaA__AFK14678

SEQ ID NO: 161504 - RNA, 1701 nt, Artificial Sequence
  derived and/or modified sequence opt4 from hemagglutinin__InfluenzaA__AFK14688
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucauccacgacgaggagcugagaaagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaaggccggcagcggcaucaucauccuggacacccccgugcacgacuggaacaccaccugcgagacccccaagggcgccgugaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161505 - RNA, 1701 nt, Artificial Sequence; identical to SEQ ID NO: 159698
  derived and/or modified sequence opt4 from hemagglutinin__InfluenzaA__AFK14697

SEQ ID NO: 161506 - RNA, 1701 nt, Artificial Sequence; identical to SEQ ID NO: 159698
  derived and/or modified sequence opt4 from hemagglutinin__InfluenzaA__AFK14713

SEQ ID NO: 161507 - RNA, 1701 nt, Artificial Sequence; identical to SEQ ID NO: 159698
  derived and/or modified sequence opt4 from hemagglutinin__InfluenzaA__AFK14722

SEQ ID NO: 161508 - RNA, 1701 nt, Artificial Sequence
  derived and/or modified sequence opt4 from hemagglutinin__InfluenzaA__AFK14731
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagaaagcagcugagcagcgugagcagcuucgagagaguggagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccgugaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161509 - RNA, 1701 nt, Artificial Sequence; identical to SEQ ID NO: 159698
  derived and/or modified sequence opt4 from hemagglutinin__InfluenzaA__AFK14740

SEQ ID NO: 161510 - RNA, 1701 nt, Artificial Sequence; identical to SEQ ID NO: 159698
  derived and/or modified sequence opt4 from hemagglutinin__InfluenzaA__AFK14749

SEQ ID NO: 161511 - RNA, 1701 nt, Artificial Sequence; identical to SEQ ID NO: 159698
  derived and/or modified sequence opt4 from hemagglutinin__InfluenzaA__AFK14756

SEQ ID NO: 161512 - RNA, 1701 nt, Artificial Sequence; identical to SEQ ID NO: 159698
  derived and/or modified sequence opt4 from hemagglutinin__InfluenzaA__AFK14764

SEQ ID NO: 161513 - RNA, 1701 nt, Artificial Sequence
  derived and/or modified sequence opt4 from hemagglutinin__InfluenzaA__AFK14779
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugggcggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcaacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161514 - RNA, 1701 nt, Artificial Sequence
  derived and/or modified sequence opt4 from hemagglutinin__InfluenzaA__AFK14788
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagaaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 161515 - RNA, 1701 nt, Artificial Sequence
  derived and/or modified sequence opt4 from hemagglutinin__InfluenzaA__AFK14798
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagaaagcagcugagcagcgugagcagcuucgagagaguggagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaacggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161516 - RNA, 1701 nt, Artificial Sequence
  derived and/or modified sequence opt4 from hemagglutinin__InfluenzaA__AFK14814
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuacgagagauacgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161517 - RNA, 1701 nt, Artificial Sequence
  derived and/or modified sequence opt4 from hemagglutinin__InfluenzaA__AFK14831
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucagcgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161518 - RNA, 1701 nt, Artificial Sequence; identical to SEQ ID NO: 155189
  derived and/or modified sequence opt4 from hemagglutinin__InfluenzaA__AFK14839

SEQ ID NO: 161519 - RNA, 1701 nt, Artificial Sequence
  derived and/or modified sequence opt4 from hemagglutinin__InfluenzaA__AFK14847
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgccagcagcuucgagagauacgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161520 - RNA, 1701 nt, Artificial Sequence; identical to SEQ ID NO: 159698
  derived and/or modified sequence opt4 from hemagglutinin__InfluenzaA__AFK14868

SEQ ID NO: 161521 - RNA, 1701 nt, Artificial Sequence; identical to SEQ ID NO: 156353
  derived and/or modified sequence opt4 from hemagglutinin__InfluenzaA__AFK14884

SEQ ID NO: 161522 - RNA, 1701 nt, Artificial Sequence; identical to SEQ ID NO: 156353
  derived and/or modified sequence opt4 from hemagglutinin__InfluenzaA__AFK14892

SEQ ID NO: 161523 - RNA, 1701 nt, Artificial Sequence; identical to SEQ ID NO: 156353
  derived and/or modified sequence opt4 from hemagglutinin__InfluenzaA__AFK14901

SEQ ID NO: 161524 - RNA, 1701 nt, Artificial Sequence; identical to SEQ ID NO: 156353
  derived and/or modified sequence opt4 from hemagglutinin__InfluenzaA__AFK14910

SEQ ID NO: 161525 - RNA, 1701 nt, Artificial Sequence; identical to SEQ ID NO: 155189
  derived and/or modified sequence opt4 from hemagglutinin__InfluenzaA__AFK14919

SEQ ID NO: 161526 - RNA, 1701 nt, Artificial Sequence; identical to SEQ ID NO: 155189
  derived and/or modified sequence opt4 from hemagglutinin__InfluenzaA__AFK14929

SEQ ID NO: 161527 - RNA, 1701 nt, Artificial Sequence; identical to SEQ ID NO: 160706
  derived and/or modified sequence opt4 from hemagglutinin__InfluenzaA__AFK25599

SEQ ID NO: 161528 - RNA, 1701 nt, Artificial Sequence
  derived and/or modified sequence opt4 from hemagglutinin__InfluenzaA__AFK25601
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgugacccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 161529 - RNA, 1701 nt, Artificial Sequence; identical to SEQ ID NO: 160706
  derived and/or modified sequence opt4 from hemagglutinin__InfluenzaA__AFK25603

SEQ ID NO: 161530 - RNA, 1701 nt, Artificial Sequence
  derived and/or modified sequence opt4 from hemagglutinin__InfluenzaA__AFK25605
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagacccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugagaagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 161531 - RNA, 1701 nt, Artificial Sequence; identical to SEQ ID NO: 160934
  derived and/or modified sequence opt4 from hemagglutinin__InfluenzaA__AFK74526

SEQ ID NO: 161532 - RNA, 1701 nt, Artificial Sequence; identical to SEQ ID NO: 155189
  derived and/or modified sequence opt4 from hemagglutinin__InfluenzaA__AFK74534

SEQ ID NO: 161533 - RNA, 1701 nt, Artificial Sequence; identical to SEQ ID NO: 155189
  derived and/or modified sequence opt4 from hemagglutinin__InfluenzaA__AFK74544

SEQ ID NO: 161534 - RNA, 1701 nt, Artificial Sequence; identical to SEQ ID NO: 155189
  derived and/or modified sequence opt4 from hemagglutinin__InfluenzaA__AFK74554

SEQ ID NO: 161535 - RNA, 1701 nt, Artificial Sequence; identical to SEQ ID NO: 155431
  derived and/or modified sequence opt4 from hemagglutinin__InfluenzaA__AFK74564

SEQ ID NO: 161536 - RNA, 1701 nt, Artificial Sequence; identical to SEQ ID NO: 157744
  derived and/or modified sequence opt4 from hemagglutinin__InfluenzaA__AFK74575

SEQ ID NO: 161537 - RNA, 1701 nt, Artificial Sequence; identical to SEQ ID NO: 155176
  derived and/or modified sequence opt4 from hemagglutinin__InfluenzaA__AFK74585

SEQ ID NO: 161538 - RNA, 1701 nt, Artificial Sequence
  derived and/or modified sequence opt4 from hemagglutinin__InfluenzaA__AFK74595
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccugaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161539 - RNA, 1701 nt, Artificial Sequence; identical to SEQ ID NO: 155189
  derived and/or modified sequence opt4 from hemagglutinin__InfluenzaA__AFK74605

SEQ ID NO: 161540 - RNA, 1701 nt, Artificial Sequence; identical to SEQ ID NO: 155431
  derived and/or modified sequence opt4 from hemagglutinin__InfluenzaA__AFK74615

SEQ ID NO: 161541 - RNA, 1701 nt, Artificial Sequence; identical to SEQ ID NO: 155431
  derived and/or modified sequence opt4 from hemagglutinin__InfluenzaA__AFK74625

SEQ ID NO: 161542 - RNA, 1701 nt, Artificial Sequence; identical to SEQ ID NO: 156291
  derived and/or modified sequence opt4 from hemagglutinin__InfluenzaA__AFK74635

SEQ ID NO: 161543 - RNA, 1701 nt, Artificial Sequence; identical to SEQ ID NO: 156291
  derived and/or modified sequence opt4 from hemagglutinin__InfluenzaA__AFK74645

SEQ ID NO: 161544 - RNA, 1701 nt, Artificial Sequence; identical to SEQ ID NO: 155189
  derived and/or modified sequence opt4 from hemagglutinin__InfluenzaA__AFK74655

SEQ ID NO: 161545 - RNA, 1701 nt, Artificial Sequence; identical to SEQ ID NO: 155189
  derived and/or modified sequence opt4 from hemagglutinin__InfluenzaA__AFK74665

SEQ ID NO: 161546 - RNA, 1701 nt, Artificial Sequence; identical to SEQ ID NO: 155189
  derived and/or modified sequence opt4 from hemagglutinin__InfluenzaA__AFK74675

SEQ ID NO: 161547 - RNA, 1701 nt, Artificial Sequence; identical to SEQ ID NO: 155189
  derived and/or modified sequence opt4 from hemagglutinin__InfluenzaA__AFK74685

SEQ ID NO: 161548 - RNA, 1701 nt, Artificial Sequence; identical to SEQ ID NO: 157744
  derived and/or modified sequence opt4 from hemagglutinin__InfluenzaA__AFK74695

SEQ ID NO: 161549 - RNA, 1701 nt, Artificial Sequence; identical to SEQ ID NO: 155189
  derived and/or modified sequence opt4 from hemagglutinin__InfluenzaA__AFK74705

SEQ ID NO: 161550 - RNA, 1701 nt, Artificial Sequence; identical to SEQ ID NO: 155189
  derived and/or modified sequence opt4 from hemagglutinin__InfluenzaA__AFK74715

SEQ ID NO: 161551 - RNA, 1701 nt, Artificial Sequence; identical to SEQ ID NO: 155189
  derived and/or modified sequence opt4 from hemagglutinin__InfluenzaA__AFK74725

SEQ ID NO: 161552 - RNA, 1701 nt, Artificial Sequence; identical to SEQ ID NO: 155189
  derived and/or modified sequence opt4 from hemagglutinin__InfluenzaA__AFK74735

SEQ ID NO: 161553 - RNA, 1701 nt, Artificial Sequence; identical to SEQ ID NO: 155189
  derived and/or modified sequence opt4 from hemagglutinin__InfluenzaA__AFK74745

SEQ ID NO: 161554 - RNA, 1701 nt, Artificial Sequence; identical to SEQ ID NO: 155189
  derived and/or modified sequence opt4 from hemagglutinin__InfluenzaA__AFK74755

SEQ ID NO: 161555 - RNA, 1701 nt, Artificial Sequence; identical to SEQ ID NO: 157744
  derived and/or modified sequence opt4 from hemagglutinin__InfluenzaA__AFK74765

SEQ ID NO: 161556 - RNA, 1701 nt, Artificial Sequence; identical to SEQ ID NO: 155189
  derived and/or modified sequence opt4 from hemagglutinin__InfluenzaA__AFK74775

SEQ ID NO: 161557 - RNA, 1701 nt, Artificial Sequence; identical to SEQ ID NO: 155189
  derived and/or modified sequence opt4 from hemagglutinin__InfluenzaA__AFK74785

SEQ ID NO: 161558 - RNA, 1701 nt, Artificial Sequence; identical to SEQ ID NO: 155189
  derived and/or modified sequence opt4 from hemagglutinin__InfluenzaA__AFK74795

SEQ ID NO: 161559 - RNA, 1701 nt, Artificial Sequence; identical to SEQ ID NO: 155189
  derived and/or modified sequence opt4 from hemagglutinin__InfluenzaA__AFK74805

SEQ ID NO: 161560 - RNA, 1701 nt, Artificial Sequence; identical to SEQ ID NO: 155189
  derived and/or modified sequence opt4 from hemagglutinin__InfluenzaA__AFK74815

SEQ ID NO: 161561 - RNA, 1701 nt, Artificial Sequence; identical to SEQ ID NO: 155189
  derived and/or modified sequence opt4 from hemagglutinin__InfluenzaA__AFK74825

SEQ ID NO: 161562 - RNA, 1701 nt, Artificial Sequence; identical to SEQ ID NO: 155189
  derived and/or modified sequence opt4 from hemagglutinin__InfluenzaA__AFK74835

SEQ ID NO: 161563 - RNA, 1701 nt, Artificial Sequence; identical to SEQ ID NO: 155189
  derived and/or modified sequence opt4 from hemagglutinin__InfluenzaA__AFK74845

SEQ ID NO: 161564 - RNA, 1701 nt, Artificial Sequence; identical to SEQ ID NO: 155189
  derived and/or modified sequence opt4 from hemagglutinin__InfluenzaA__AFK74895

SEQ ID NO: 161565 - RNA, 1701 nt, Artificial Sequence; identical to SEQ ID NO: 155189
  derived and/or modified sequence opt4 from hemagglutinin__InfluenzaA__AFK74905

SEQ ID NO: 161566 - RNA, 1701 nt, Artificial Sequence; identical to SEQ ID NO: 155189
  derived and/or modified sequence opt4 from hemagglutinin__InfluenzaA__AFK74915

SEQ ID NO: 161567 - RNA, 1701 nt, Artificial Sequence
  derived and/or modified sequence opt4 from hemagglutinin__InfluenzaA__AFK74925
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggugccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161568 - RNA, 1701 nt, Artificial Sequence; identical to SEQ ID NO: 156291
  derived and/or modified sequence opt4 from hemagglutinin__InfluenzaA__AFK74935

SEQ ID NO: 161569 - RNA, 1701 nt, Artificial Sequence; identical to SEQ ID NO: 155189
  derived and/or modified sequence opt4 from hemagglutinin__InfluenzaA__AFK74945

SEQ ID NO: 161570 - RNA, 1701 nt, Artificial Sequence; identical to SEQ ID NO: 155189
  derived and/or modified sequence opt4 from hemagglutinin__InfluenzaA__AFK74955

SEQ ID NO: 161571 - RNA, 1701 nt, Artificial Sequence; identical to SEQ ID NO: 155189
  derived and/or modified sequence opt4 from hemagglutinin__InfluenzaA__AFK74965

SEQ ID NO: 161572 - RNA, 1701 nt, Artificial Sequence; identical to SEQ ID NO: 155280
  derived and/or modified sequence opt4 from hemagglutinin__InfluenzaA__AFK74975

SEQ ID NO: 161573 - RNA, 1701 nt, Artificial Sequence; identical to SEQ ID NO: 155189
  derived and/or modified sequence opt4 from hemagglutinin__InfluenzaA__AFK74985

SEQ ID NO: 161574 - RNA, 1701 nt, Artificial Sequence; identical to SEQ ID NO: 157744
  derived and/or modified sequence opt4 from hemagglutinin__InfluenzaA__AFK74995

SEQ ID NO: 161575 - RNA, 1701 nt, Artificial Sequence; identical to SEQ ID NO: 155189
  derived and/or modified sequence opt4 from hemagglutinin__InfluenzaA__AFK75005

SEQ ID NO: 161576 - RNA, 1701 nt, Artificial Sequence
  derived and/or modified sequence opt4 from hemagglutinin__InfluenzaA__AFK75015
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcguguga

SEQ ID NO: 161577 - RNA, 1701 nt, Artificial Sequence; identical to SEQ ID NO: 155431
  derived and/or modified sequence opt4 from hemagglutinin__InfluenzaA__AFK75025

SEQ ID NO: 161578 - RNA, 1701 nt, Artificial Sequence; identical to SEQ ID NO: 155431
  derived and/or modified sequence opt4 from hemagglutinin__InfluenzaA__AFK75035

SEQ ID NO: 161579 - RNA, 1701 nt, Artificial Sequence; identical to SEQ ID NO: 155431
  derived and/or modified sequence opt4 from hemagglutinin__InfluenzaA__AFK75045

SEQ ID NO: 161580 - RNA, 1701 nt, Artificial Sequence; identical to SEQ ID NO: 155431
  derived and/or modified sequence opt4 from hemagglutinin__InfluenzaA__AFK75055

SEQ ID NO: 161581 - RNA, 1701 nt, Artificial Sequence; identical to SEQ ID NO: 155189
  derived and/or modified sequence opt4 from hemagglutinin__InfluenzaA__AFK75065

SEQ ID NO: 161582 - RNA, 1701 nt, Artificial Sequence; identical to SEQ ID NO: 155189
  derived and/or modified sequence opt4 from hemagglutinin__InfluenzaA__AFK75075

SEQ ID NO: 161583 - RNA, 1701 nt, Artificial Sequence; identical to SEQ ID NO: 156353
  derived and/or modified sequence opt4 from hemagglutinin__InfluenzaA__AFK75085

SEQ ID NO: 161584 - RNA, 1701 nt, Artificial Sequence; identical to SEQ ID NO: 156353
  derived and/or modified sequence opt4 from hemagglutinin__InfluenzaA__AFK75095

SEQ ID NO: 161585 - RNA, 1701 nt, Artificial Sequence; identical to SEQ ID NO: 155189
  derived and/or modified sequence opt4 from hemagglutinin__InfluenzaA__AFK75105

SEQ ID NO: 161586 - RNA, 1701 nt, Artificial Sequence; identical to SEQ ID NO: 155431
  derived and/or modified sequence opt4 from hemagglutinin__InfluenzaA__AFK77857

SEQ ID NO: 161587 - RNA, 1701 nt, Artificial Sequence; identical to SEQ ID NO: 155431
  derived and/or modified sequence opt4 from hemagglutinin__InfluenzaA__AFK77867

SEQ ID NO: 161588 - RNA, 1701 nt, Artificial Sequence; identical to SEQ ID NO: 160717
  derived and/or modified sequence opt4 from hemagglutinin__InfluenzaA__AFK77877

SEQ ID NO: 161589 - RNA, 1701 nt, Artificial Sequence; identical to SEQ ID NO: 155189
  derived and/or modified sequence opt4 from hemagglutinin__InfluenzaA__AFK77887

SEQ ID NO: 161590 - RNA, 1701 nt, Artificial Sequence
  derived and/or modified sequence opt4 from hemagglutinin__InfluenzaA__AFK77897
augaaggccauccugguggugcugcuguacaccuucgccaccgccaacgccgacacccugugcaucggcuaccacgccaacaacagcaccgacaccguggacaccgugcuggagaagaacgugaccgugacccacagcaucaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161591 - RNA, 1701 nt, Artificial Sequence; identical to SEQ ID NO: 159570
  derived and/or modified sequence opt4 from hemagglutinin__InfluenzaA__AFK78028

SEQ ID NO: 161592 - RNA, 1701 nt, Artificial Sequence; identical to SEQ ID NO: 155431
  derived and/or modified sequence opt4 from hemagglutinin__InfluenzaA__AFK78187

SEQ ID NO: 161593 - RNA, 1701 nt, Artificial Sequence; identical to SEQ ID NO: 159375
  derived and/or modified sequence opt4 from hemagglutinin__InfluenzaA__AFM45476

SEQ ID NO: 161594 - RNA, 1701 nt, Artificial Sequence
  derived and/or modified sequence opt4 from hemagglutinin__InfluenzaA__AFM45487
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161595 - RNA, 1701 nt, Artificial Sequence; identical to SEQ ID NO: 159375
  derived and/or modified sequence opt4 from hemagglutinin__InfluenzaA__AFM45489

SEQ ID NO: 161596 - RNA, 1701 nt, Artificial Sequence; identical to SEQ ID NO: 161594
  derived and/or modified sequence opt4 from hemagglutinin__InfluenzaA__AFM45494

SEQ ID NO: 161597 - RNA, 1701 nt, Artificial Sequence
  derived and/or modified sequence opt4 from hemagglutinin__InfluenzaA__AFM68954
augaaggccagacugcuggugcugcugugcgcccuggccgccaccgacgccgacaccaucugcaucggcuaccacgccaacaacagcaccgacaccguggacacccugcuggagaagaacgugaccgugacccacagcgugaaccugcuggaggacagccacaacggcaagcugugcaagcugaagggcaucgccccccugcagcugggcaagugcaacaucgccggcuggcugcugggcaaccccgagugcgacagccugcugcccgccagaagcuggagcuacaucguggagacccccaacagcgagaacggcgccugcuaccccggcgacuucaucgacuacgaggagcugaaggagcagcugagcagcgugagcagccuggagagauucgagaucuuccccaaggagagcagcuggcccaaccacaacacccugaagggcgugaccgccagcugcagccacggcggcaagagcagcuucuacagaaaccugcuguggcugaccaagaccgaggacagcuaccccaagcugagcaacagcuacgugaacaacaagggcaaggaggugcuggugcuguggggcgugcaccaccccagcagcagcgacgagcagcagagccuguaccacaacgugaacgccuacgugagcguggugagcagcaacuacaacggcagauucacccccgagaucgccgccagacccaaggugagaaaccagcccggcagaaugaacuacuacuggacccugcuggagcccggcgacaccaucaucuucgaggccaccggcaaccugaucgcccccugguacgccuucgcccugagcagaggcuucggcagcggcaucaucaccagcaacgccagcaugcacgagugcaacaccaagugccagaccccccagggcgccaucaacagcagccugcccuuccagaacauccaccccgugaccaucggcgagugccccaaguacgugagaagcaccaagcugagaauggugaccggccugagaaacauccccagcauccaguucagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugagcaaggaguucaacaaccuggagaagagaauggagaaccugaacaagaagguggacgacggcuuccuggacaucuggaccuacaacgccgagcugcuggugcugcuggagaacgagagaacccuggacuuccacgaccugaacgugaagaaccuguacgagaaggugaagagccagcugaagaacaacgccaaggagaucggcaacggcugcuucgaguucuaccacaagugcgacaacaagugcauggagagcgugagaaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161598 - RNA, 1701 nt, Artificial Sequence
  derived and/or modified sequence opt4 from hemagglutinin__InfluenzaA__AFM68965
augaagaccaucaucgcccugagcuacaucuucugccaggugcuggcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcuacgccugcaagagaggccccgacaacagcuucuucagcagacugaacuggcuguacaagagcgagagcaccuaccccgugcugaacgugaccaugcccaacaacgacaacuucgacaagcuguacaucuggggcgugcaccaccccagcaccgacaaggagcagaccaaccuguacgugcaggccagcggcagagugaccgugagcaccaagagaagccagcagaccaucauccccaacgugggcagcagacccugggugagaggccugagcagcggcaucagcaucuacuggaccaucgugaagcccggcgacauccugcugaucaacagcaacggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaaggccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161599 - RNA, 1701 nt, Artificial Sequence
  derived and/or modified sequence opt4 from hemagglutinin__InfluenzaA__AFM68987
augaagaccaucaucgcccugagcuacaucuucugccugguguucgcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacgccugcaagagaggcagcgacaagagcuucuucagcagacugaacuggcuguacgagagcgagagcaaguaccccgugcugaacgugaccaugcccaacaacggcaacuucgacaagcuguacaucuggggcgugcaccaccccagcaccgacaaggagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaacggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161600 - RNA, 1701 nt, Artificial Sequence
  derived and/or modified sequence opt4 from hemagglutinin__InfluenzaA__AFM71720
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuacagcaacugcuaccccuacgacgugcccgacuacgccagccugagaagccugguggccagcagcggcacccuggaguucaucaacgaggacuucaacuggaccggcgugacccagagcggcggcagcuacgccugcaagagaggcagcgugaacagcuucuucagcagacugaacuggcugcacgagagcgaguacaaguaccccgcccugaacguggccaugcccaacaacggcaaguucgacaagcuguacaucuggggcgugcaccaccccaucaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccuguucaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161601 - RNA, 1701 nt, Artificial Sequence
  derived and/or modified sequence opt4 from hemagglutinin__InfluenzaA__AFM71731
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcgagagcuacgccugcaagagaggcagcgugaagagcuucuucagcagacugaacuggcugcacaagagcgaguacaaguaccccgcccugaacgugaccaugcccaacaacggcaaguucgacaagcuguacaucuggggcgugcaccaccccagcaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161602 - RNA, 1701 nt, Artificial Sequence
  derived and/or modified sequence opt4 from hemagglutinin__InfluenzaA__AFM71754
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccccuacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgcccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161603 - RNA, 1701 nt, Artificial Sequence
  derived and/or modified sequence opt4 from hemagglutinin__InfluenzaA__AFM71768
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacgacuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccccuacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgcccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161604 - RNA, 1701 nt, Artificial Sequence
  derived and/or modified sequence opt4 from hemagglutinin__InfluenzaA__AFM71791
augaagaccaucaucgcccugagcuacacccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccccuacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgagcugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161605 - RNA, 1701 nt, Artificial Sequence
  derived and/or modified sequence opt4 from hemagglutinin__InfluenzaA__AFM71824
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccaggacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccccuacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161606 - RNA, 1701 nt, Artificial Sequence
  derived and/or modified sequence opt4 from hemagglutinin__InfluenzaA__AFM71835
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcagcugcuaccccuacgacgugcccgacuacgccagccugagaagccugguggccagcagcggcacccuggaguucaacagcgagagcuucaacuggaccggcgugacccagaacggcaccagcagcgccugcaucagaagaagcuacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccccuacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacaucaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagccuggccaucagcugcuuccugcugugcguggcccugcugggcuucaucaugugggccugccagaagggcaacaucagaugcaacaucugcaucuga

SEQ ID NO: 161607 - RNA, 1698 nt, Artificial Sequence
  derived and/or modified sequence opt4 from hemagglutinin__InfluenzaA__AFM71846
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaaccacaacaccaacggcgugaccgccgccugcagccacgagggcaagagcagcuucuacagaaaccugcuguggcugaccgagaaggagggcagcuaccccaagcugaagaacagcuacgugaacaagaagggcaaggaggugcuggugcuguggggcauccaccaccccagcaacagcaaggagcagcagaaccuguaccagaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 161608 - RNA, 1701 nt, Artificial Sequence; identical to SEQ ID NO: 154838
  derived and/or modified sequence opt4 from hemagglutinin__InfluenzaA__AFM71857

SEQ ID NO: 161609 - RNA, 1701 nt, Artificial Sequence
  derived and/or modified sequence opt4 from hemagglutinin__InfluenzaA__AFM71868
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcagcugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccgugaccgacaacgaccagaucagacuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161610 - RNA, 1701 nt, Artificial Sequence; identical to SEQ ID NO: 159518
  derived and/or modified sequence opt4 from hemagglutinin__InfluenzaA__AFM71879

SEQ ID NO: 161611 - RNA, 1701 nt, Artificial Sequence
  derived and/or modified sequence opt4 from hemagglutinin__InfluenzaA__AFM71890
augaaggccagacugcuggugcugcugugcgcccuggccgccaccgacgccgacaccaucugcaucggcuaccacgccaacaacagcaccgacaccguggacacccugcuggagaagaacgugaccgugacccacagcgugaaccugcuggaggacagccacaacggcaagcugugcaagcugaagggcaucgccccccugcagcugggcaagugcaacaucgccggcuggcugcugggcaaccccgagugcgacagccugcugcccgccagaagcuggagcuacaucguggagacccccaacagcgagaacggcgccugcuaccccggcgacuucaucgacuacgaggagcugaaggagcagcugagcagcgugagcagccuggagagauucgagaucuuccccaaggagagcagcuggcccaaccacaacacccugaagggcgugaccgccagcugcagccacggcggcaagagcagcuucuacagaaaccugcuguggcugaccaagaccgaggacagcuaccccaagcugagcaacagcuacgugaacaacaagggcaaggaggugcuggugcuguggggcgugcaccaccccagcagcagcgacgagcagcagagccuguaccacaacgugaacgccuacgugagcguggugagcagcaacuacaacagaagauucacccccgagaucgccgccagacccaaggugagaaaccagcccggcagaaugaacuacuacuggacccugcuggagcccggcgacaccaucaucuucgaggccaccggcaaccugaucgcccccugguacgccuucgcccugagcagaggcuucggcagcggcaucaucaccagcaacgccagcaugcacgagugcaacaccaagugccagaccccccagggcgccaucaacagcagccugcccuuccagaacauccaccccgugaccaucggcgagugccccaaguacgugagaagcaccaagcugagaauggugaccggccugagaaacauccccagcauccaguucagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugagcaaggaguucaacaaccuggagaagagaauggagaaccugaacaagaagguggacgacggcuuccuggacaucuggaccuacaacgccgagcugcuggugcugcuggagaacgagagaacccuggacuuccacgaccugaacgugaagaaccuguacgagaaggugaagagccagcugaagaacaacgccaaggagaucggcaacggcugcuucgaguucuaccacaagugcgacaacaagugcauggagagcgugagaaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161612 - RNA, 1701 nt, Artificial Sequence; identical to SEQ ID NO: 161597
  derived and/or modified sequence opt4 from hemagglutinin__InfluenzaA__AFM71901

SEQ ID NO: 161613 - RNA, 1701 nt, Artificial Sequence
  derived and/or modified sequence opt4 from hemagglutinin__InfluenzaA__AFM71923
augaagaccaucaucgcccugagcuacaucuucugccuggugcugggccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucgacugcacccugaucgacgcccugcugggcgacccccacugcgacagcuuccagaacgagaccugggaccuguucguggagagaagcaaggccuucagcaacugcuaccccuacgacgugcccgacuacgccagccugagaagccugguggccagcagcggcacccuggaguucaucaacgagggcuucaccuggaccggcgugacccagaacggcggcagcaacgccugcaagagaggccccgacagcggcuucuucagcagacugaacuggcuguacaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccaagagaagccagcagaccaucauccccaacaucggcagcagacccugggugagaggccugagcagcagaaucagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucagaaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161614 - RNA, 1701 nt, Artificial Sequence
  derived and/or modified sequence opt4 from hemagglutinin__InfluenzaA__AFM71934
augaagaccaucaucgcccugagcuacaucuucugccuggugcugggccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucgacugcacccugaucgacgcccugcugggcgacccccacugcgacggcuuccagaacgagaccugggaccuguucguggagagaagcaaggccuucagcaacugcuaccccuacgacgugcccgacuacgccagccugagaagccugguggccagcagcggcacccuggaguucaucaacgagggcuucaccuggaccggcgugacccagaacggcggcagcaacgccugcaagagaggccccgacagcggcuucuucagcagacugaacuggcuguacaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccaagggcagccagcagaccaucauccccaacaucggcagcagacccugggugagaggccugagcagcagaaucagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucagaaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161615 - RNA, 1701 nt, Artificial Sequence
  derived and/or modified sequence opt4 from hemagglutinin__InfluenzaA__AFM71945
augaagaccaucaucgcccugagcuacaucuucugccuggugcugggccaggacuuccccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucaacugcacccugaucgacgcccugcugggcgacccccacugcgacggcuuccagaacgagaccugggaccuguucguggagagaagcaaggccuucagcaacugcuaccccuacgacgugcccgacuacgccagccugagaagccugguggccagcagcggcacccuggaguucaucaacgagggcuucaccuggaccggcgugacccagaacggcggcagcaacgccugcaagagaggccccgacagcggcuucuucagcagacugaacuggcuguacaagagcggcagcgccuaccccgugcugaacgugaccaugcccaacaacgacaacuucgacaagcuguacaucuggggcgugcaccaccccagcaccgaccaggagcagaccaaccuguacgugcaggccagcggcagagugaccgugagcaccaagagaagccagcagaccaucauccccaacaucggcagcagacccugggugagaggccugagcagcagaaucagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161616 - RNA, 1701 nt, Artificial Sequence; identical to SEQ ID NO: 161615
  derived and/or modified sequence opt4 from hemagglutinin__InfluenzaA__AFM71956

SEQ ID NO: 161617 - RNA, 1704 nt, Artificial Sequence
  derived and/or modified sequence opt4 from hemagglutinin__InfluenzaA__AFM71978
augaagaccaucaucgcccugagcuacaucuucugccugguguucgcccaggaccugcccggcaacgacaacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcaacgccugcaagagaggccccgacagcggcuucuucagcagacugaacuggcuguacaagagcggcagcaccuaccccgugcagaacgugaccaugcccaacaacgacaacagcgacaagcuguacaucuggggcgugcaccaccccagcaccgacaaggagcagaccaaccuguacgugcaggccagcggcaaggugaccgugagcaccaagagaagccagcagaccaucauccccaacgugggcagcagacccugggugagaggccugagcagcagaaucagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161618 - RNA, 1701 nt, Artificial Sequence
  derived and/or modified sequence opt4 from hemagglutinin__InfluenzaA__AFM71989
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccagcaccgacaaggaccagaucuuccuguacacccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161619 - RNA, 1701 nt, Artificial Sequence
  derived and/or modified sequence opt4 from hemagglutinin__InfluenzaA__AFM72010
augaagaccaucaucgcccugagcuacaucuucugccaggugcuggcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcuacgccugcaagagaggccccgacaagagcuucuucagcagacugaacuggcuguacgagagcgagagcaccuaccccgugcugaacgugaccaugcccaacaacgacaacuucgacaagcuguacaucuggggcgugcaccaccccagcaccgacaaggagcagaccaagcuguacgugcaggccagcggcagagugaccgugagcaccaagagaagccagcagaccaucauccccaacgugggcagcagacccugggugagaggccugagcagcagaaucagcaucuacuggaccaucgugaagcccggcgacauccugcugaucaacagcaacggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161620 - RNA, 1701 nt, Artificial Sequence; identical to SEQ ID NO: 153435
  derived and/or modified sequence opt4 from hemagglutinin__InfluenzaA__AFM72021

SEQ ID NO: 161621 - RNA, 1701 nt, Artificial Sequence
  derived and/or modified sequence opt4 from hemagglutinin__InfluenzaA__AFM72032
augaagaccaucaucgcccugagcuacauguucugccugguguucgcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacaccugcaagagaggcagcaacaacagcuucuucagcagacugaacuggcuguacgagagcgagagcaaguaccccgugcugaacgugaccaugcccaacaacggcaaguucgacaagcuguacaucuggggcauccaccaccccagcaccgacaaggagcagaccaaccuguacaucagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161622 - RNA, 1701 nt, Artificial Sequence
  derived and/or modified sequence opt4 from hemagglutinin__InfluenzaA__AFM72043
augaagaccaucaucgcccugagcuacauguucugccugguguucgcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcagcaccugcaagagaggcagcaacaacagcuucuucagcagacugaacuggcuguacgagagcgagagcaaguaccccgugcugaacgugaccaugcccaacaacggcaaguucgacaagcuguacaucuggggcauccaccaccccagcaccgacaaggagcagaccaaccuguacaucagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161623 - RNA, 1701 nt, Artificial Sequence
  derived and/or modified sequence opt4 from hemagglutinin__InfluenzaA__AFM72054
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacaaccacaacggcaagcugugcaagcugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaagcacaacgugaccaagggcgugaccgccgccugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagccacuacaacagaagauucacccccgagaucgccaagagacccaaggugagaaaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcaucaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161624 - RNA, 1701 nt, Artificial Sequence; identical to SEQ ID NO: 161623
  derived and/or modified sequence opt4 from hemagglutinin__InfluenzaA__AFM72065

SEQ ID NO: 161625 - RNA, 1701 nt, Artificial Sequence
  derived and/or modified sequence opt4 from hemagglutinin__InfluenzaA__AFM72087
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucaucgagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacaccugcaagagaggcagcgugaacagcuucuucagcagacugaacuggcuguacgagagcgaguacaaguaccccgcccugaacgugaccaugcccaacaacggcaaguucgacaagcuguacaucuggggcgugcaccaccccagcaccgagaaggagcagaccaaccuguacgugagagccagcggcagagugaccgugagcaccaagagaagccagcagaccgugauccccaacaucggcagcagccccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccaguacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161626 - RNA, 1701 nt, Artificial Sequence
  derived and/or modified sequence opt4 from hemagglutinin__InfluenzaA__AFM72098
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuacagcaacugcuaccccuacgacgugcccgacuacgccagccugagaagccugguggccagcagcggcacccuggaguucaucaacgaggacuucaacuggaccggcgugacccagagcggcggcagcuacgccugcaagagaggcagcgugaacagcuucuucagcagacugaacuggcuguacaagagcgaguacaaguaccccgcccugaacgugaccaugcccaacaacggcaaguucgacaagcuguacaucuggggcgugcaccaccccgugaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161627 - RNA, 1701 nt, Artificial Sequence
  derived and/or modified sequence opt4 from hemagglutinin__InfluenzaA__AFM72109
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuacagcaacugcuaccccuacgacgugcccgacuacgccagccugagaagccugguggccagcagcggcacccuggaguucaucaacgaggacuucaacuggaccggcgugacccagagcggcggcagcuacgccugcaagagaggcagcgugaacagcuucuucagcagacugaacuggcugcacaagagcgaguacaaguaccccgcccugaacgugaccaugcccaacaacggcaaguucgacaagcuguacaucuggggcgugcaccaccccaucaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161628 - RNA, 1701 nt, Artificial Sequence
  derived and/or modified sequence opt4 from hemagglutinin__InfluenzaA__AFM72120
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuacagcaacugcuaccccuacgacgugcccgacuacgccagccugagaagccugguggccagcagcggcacccuggaguucaucaacgaggacuucaacuggaccggcgugacccagagcggcggcagcuacgccugcaagagaggcagcgugaacagcuucuucagcagacugaacuggcugcacgagagcgaguacaaguaccccgcccugaacgugaccaugcccaacaacggcaaguucgacaagcuguacaucuggggcgugcaccaccccaucaccgacagagagcagaccaaccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161629 - RNA, 1701 nt, Artificial Sequence
  derived and/or modified sequence opt4 from hemagglutinin__InfluenzaA__AFM72131
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaaggacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaacggcguggcccagagcggcgagagcuacgccugcaagagaggcagcgugaagagcuucuucagcagacugaacuggcugcacgagagcgaguacaaguaccccgcccugaacgugaccaugcccaacaacggcaaguucgacaagcuguacaucuggggcgugcaccaccccagcaccgacagagagcagaccaagcuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161630 - RNA, 1701 nt, Artificial Sequence
  derived and/or modified sequence opt4 from hemagglutinin__InfluenzaA__AFM72142
augaagaccaucaucgcccugagcuacaucagcugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcggcagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagagaccagaccagccuguacgugagagccagcggcagagugaccgugagcaccaagagaagccagcagaccgugauccccaacaucggcagcagacccugggugagaggccagagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161631 - RNA, 1701 nt, Artificial Sequence
  derived and/or modified sequence opt4 from hemagglutinin__InfluenzaA__AFM72153
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcggcagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcggcagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugacccccaacaucggcagcagacccugggugagaggccagagcagcagaaucggcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161632 - RNA, 1701 nt, Artificial Sequence
  derived and/or modified sequence opt4 from hemagglutinin__InfluenzaA__AFM72164
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagccccaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgagaacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccgacaucggcuacagacccugggugagaggccagagcagcagaaucagcauccacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugguggagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161633 - RNA, 1701 nt, Artificial Sequence
  derived and/or modified sequence opt4 from hemagglutinin__InfluenzaA__AFM72175
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagccccaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgagaacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccaaccuguacgugagagccagcggcagagugaccgugagcaccaagagaagccagcagaccgugauccccgacaucggcuacagacccugggugagaggccagagcagcagaaucagcauccacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugguggagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161634 - RNA, 1701 nt, Artificial Sequence
  derived and/or modified sequence opt4 from hemagglutinin__InfluenzaA__AFM72197
augaagaccaucaucgcccugagcuacauccugugcaugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcgugaagagcuucuucagcagacugaacuggcugcacaagcuggaguacaaguaccccgcccugaacgugaccaugcccaacaacgacaaguucgacaagcuguacaucuggggcgugcaccaccccaucaccgacagcgagcagaccagccuguacgugcaggccagcggcagagugaccgugagcaccaagagaagccagcagaccgugauccccaacaucggcuacagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucaagugcaacaucugcaucuga

SEQ ID NO: 161635 - RNA, 1701 nt, Artificial Sequence
  derived and/or modified sequence opt4 from hemagglutinin__InfluenzaA__AFM72208
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaacagcuucuucagcagacugaacuggcugcaccagcugaaguacagauaccccgcccugaacgugaccaugcccaacaacgacaaguucgacaagcuguacaucuggggcgugcaccaccccagcaccgacagcgaccagaccagccuguacacccaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161636 - RNA, 1701 nt, Artificial Sequence
  derived and/or modified sequence opt4 from hemagglutinin__InfluenzaA__AFM72219
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaacagcuucuucagcagacugaacuggcugcaccagcugaaguacagauaccccgcccugaacgugaccaugcccaacaacgacaaguucgacaagcuguacaucuggggcgugcaccaccccagcaccgacagcgaccagaccagccuguacacccaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaagagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161637 - RNA, 1698 nt, Artificial Sequence
  derived and/or modified sequence opt4 from hemagglutinin__InfluenzaA__AFM72230
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaagaagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgugaacaacaaggagaaggaggugcuggugcuguggggcgugcaccacccccccaacaucggcaaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161638 - RNA, 1701 nt, Artificial Sequence
  derived and/or modified sequence opt4 from hemagglutinin__InfluenzaA__AFM72246
augaagaccaucaucgcccugagcuacauccugugccugguguucgcccagaagcugcccggcaacgacaacagcaccgccacccugugccugggccaccacgccgugagcaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagcaucuacgcccaggccagcggcagagugaccgugagcaccaagagaagccagcagaccgugauccccaacaucggcagcagccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161639 - RNA, 1701 nt, Artificial Sequence
  derived and/or modified sequence opt4 from hemagglutinin__InfluenzaA__AFM72257
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaacuacaaguaccccgcccugaacgugaccaugcccaacaacgagaaguucgacaagcuguacaucuggggcgugcaccaccccagcaccgacagcgaccagaucagcaucuacgcccaggccagcggcagagugaccgugagcaccaagagaagccagcagaccgugauccccaacaucggcagcagacccugggugagaggcgugagcagcggcaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161640 - RNA, 1701 nt, Artificial Sequence
  derived and/or modified sequence opt4 from hemagglutinin__InfluenzaA__AFM72268
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaacuacaaguaccccgcccugaacgugaccaugcccaacaacgagaaguucgacaagcuguacaucuggggcgugcaccaccccaacaccgacagcgaccagaucagcaucuacgcccaggccagcggcagagugaccgugagcaccaagagaagccagcagaccgugauccccaacaucggcagcagacccugggugagaggcgugagcagcggcaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161641 - RNA, 1701 nt, Artificial Sequence
  derived and/or modified sequence opt4 from hemagglutinin__InfluenzaA__AFM72279
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagcaucuacgcccaggccagcggcagagugaccgugagcaccaagagaagccagcagaccgugauccccaacaucggcagcaagcacugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161642 - RNA, 1701 nt, Artificial Sequence
  derived and/or modified sequence opt4 from hemagglutinin__InfluenzaA__AFM72290
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaggacaaguaccccgcccugaacgugaccaugcccaacaacgagaaguucgacaagcuguacaucuggggcgugcaccaccccagcaccgacagcgaccagaucagcaucuacgcccaggccagcggcagagugaccgugagcaccaagagaagccagcagaccgugauccccaacaucggcagcaagcacugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161643 - RNA, 1701 nt, Artificial Sequence
  derived and/or modified sequence opt4 from hemagglutinin__InfluenzaA__AFM72301
augaagaccaucaucgcccugagcuacauccugugccugguguucagccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaagagaagaagcaacaagagcuucuucagcagacugaacuggcugacccagcugaaguacaaguaccccgcccugaacgugaccaugcccaacaacgagaaguucgacaagcuguacaucuggggcgugcaccaccccgugaccgacagcgaccagaucagccuguacgcccaggccagcggcagaaucaccgugagcaccaagagaagccagcagaccgugauccccaacaucggcuacagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161644 - RNA, 1701 nt, Artificial Sequence
  derived and/or modified sequence opt4 from hemagglutinin__InfluenzaA__AFM72312
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccgugaccgacagcgaccagaucaaccuguacgcccaggccagcggcagaaucaccgugagcaccaagagaagccagcagaccgugauccccaacaucggcuacagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161645 - RNA, 1701 nt, Artificial Sequence
  derived and/or modified sequence opt4 from hemagglutinin__InfluenzaA__AFM72323
augaaggccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccgugaccgacagcgaccagaucaaccuguacgcccaggccagcggcagaaucaccgugagcaccaagagaagccagcagaccgugauccccaacaucggcuacagacccagagugagagacaaccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161646 - RNA, 1701 nt, Artificial Sequence
  derived and/or modified sequence opt4 from hemagglutinin__InfluenzaA__AFM72334
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcugcaccccggcaccuacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161647 - RNA, 1701 nt, Artificial Sequence
  derived and/or modified sequence opt4 from hemagglutinin__InfluenzaA__AFM72345
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccgugaccgacagcgaccagaucagccuguacacccaggccagcggcagaaucaccgugagcaccaagagaagccagcagaccgugauccccaacaucggcuucagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161648 - RNA, 1701 nt, Artificial Sequence
  derived and/or modified sequence opt4 from hemagglutinin__InfluenzaA__AFM72356
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucaaccuguacgugcaggccagcggcagaaucaccgugagcaccaagagaagccagcagaccgugauccccaacaucggcagcagacccagagugagagacgugcccagcagaaucagcaucuacuggaccaucgugaagcccggcgacauccugcugaucagcagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161649 - RNA, 1701 nt, Artificial Sequence
  derived and/or modified sequence opt4 from hemagglutinin__InfluenzaA__AFM72367
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguucaaguaccccgcccugaacgugaccaugcccaacaacgagaaguucgacaagcuguacaucuggggcgugcaccaccccgugaccgacaacgaccagaucaaccuguacgcccaggccagcggcagaaucaccgugagcaccaagagaagccagcagaccgugauccccaacaucggcagcagacccagagugagagacgugcccagcagaaucagcaucuacuggaccaucgugaagcccggcgacauccugcugaucagcagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161650 - RNA, 1701 nt, Artificial Sequence
  derived and/or modified sequence opt4 from hemagglutinin__InfluenzaA__AFM72378
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccagcugaacuucaaguaccccgcccugaacgugaccaugcccaacaacgagcaguucgacaagcuguacaucuggggcgugcaccaccccgugaccgacaaggaccagaucuuccuguacgcccaggccagcggcagaaucaccgugagcaccaagagaagccagcaggccgugauccccaacaucggcuacagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161651 - RNA, 1701 nt, Artificial Sequence
  derived and/or modified sequence opt4 from hemagglutinin__InfluenzaA__AFM72389
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccgugaccgacaaggaccagaucuuccuguacgcccaggccagcggcagaaucaccgugagcaccaagagaagccagcaggccgugauccccaacaucggcuacagacccagagugagaaacaaccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161652 - RNA, 1701 nt, Artificial Sequence
  derived and/or modified sequence opt4 from hemagglutinin__InfluenzaA__AFM72400
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcugcaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161653 - RNA, 1701 nt, Artificial Sequence
  derived and/or modified sequence opt4 from hemagglutinin__InfluenzaA__AFM72411
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaagagaggcagcaacaacagcuucuucagcagacugaacuggcugacccagagcaaguucaaguaccccgcccugaacgugaccaugcccaacaacgaggaguucgacaagcuguacaucuggggcgugcaccaccccgugaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggacuucgagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161654 - RNA, 1701 nt, Artificial Sequence
  derived and/or modified sequence opt4 from hemagglutinin__InfluenzaA__AFM72422
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgaggaguucgacaagcuguacaucuggggcgugcaccaccccgugaccgacaacgaccagaucuuccuguacgcccaggccagcggcagaaucaccgugagcaccaagagaagccagcagaccgugauccccaacaucggcuucagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacgccgaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161655 - RNA, 1701 nt, Artificial Sequence
  derived and/or modified sequence opt4 from hemagglutinin__InfluenzaA__AFM72433
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgaggaguucgacaagcuguacaucuggggcgugcaccaccccgugaccgacaacgaccagaucuuccuguacgcccaggccagcggcagaaucaccgugagcaccaagagaagccagcagaccgugauccccaacaucggcuucagacccagagugagaaacaaccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacgccgaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161656 - RNA, 1701 nt, Artificial Sequence
  derived and/or modified sequence opt4 from hemagglutinin__InfluenzaA__AFM72444
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgaggaguucgacaagcuguacaucuggggcgugcaccaccccgugaccgacaacgaccagauccugcuguacgcccaggccagcggcagaaucaccgugagcaccaagagaagccagcagaccgugauccccaacaucggcuucagacccagagugagaaacaaccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacgccgaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161657 - RNA, 1701 nt, Artificial Sequence
  derived and/or modified sequence opt4 from hemagglutinin__InfluenzaA__AFM72455
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccagcugaaguucaaguaccccgcccugaacgugaccaugcccaacaacgaggaguucgacaagcuguacaucuggggcgugcaccaccccgugaccgacaacgaccagaucuuccuguacgcccaggccagcggcagaaucaccgugagcaccaagagaagccagcagaccgugauccccaacaucggcuucagacccagagugagaaacaaccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacgccgaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161658 - RNA, 1701 nt, Artificial Sequence
  derived and/or modified sequence opt4 from hemagglutinin__InfluenzaA__AFM72466
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgaggaguucgacaagcuguacaucuggggcgugcaccaccccgugaccgacaaggaccagaucuuccuguacgcccaggccagcggcagaaucaccgugagcaccaagagaagccagcagaccgugauccccaacaucggcuucagacccagagugagaaacaaccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacgccgaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161659 - RNA, 1701 nt, Artificial Sequence
  derived and/or modified sequence opt4 from hemagglutinin__InfluenzaA__AFM72488
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccagcugaaguucaaguaccccgcccugaacgugaccaugcccaacaacgagaaguucgacaagcuguacaucuggggcgugcaccaccccgugaccgacaacgagcagaucuuccuguacgcccaggccagcggcagaaucaccgugagcaccaagagaagccagcagaccgugauccccaacaucggcuucagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcaagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161660 - RNA, 1701 nt, Artificial Sequence
  derived and/or modified sequence opt4 from hemagglutinin__InfluenzaA__AFM72499
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccagcugaaguucaaguaccccgcccugaacgugaccaugcccaacaacgagaaguucgacaagcuguacaucuggggcgugcaccaccccgugaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161661 - RNA, 1698 nt, Artificial Sequence
  derived and/or modified sequence opt4 from hemagglutinin__InfluenzaA__AFM72521
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcagacugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagccuggagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcaaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161662 - RNA, 1698 nt, Artificial Sequence; identical to SEQ ID NO: 161661
  derived and/or modified sequence opt4 from hemagglutinin__InfluenzaA__AFM72532

SEQ ID NO: 161663 - RNA, 1698 nt, Artificial Sequence; identical to SEQ ID NO: 161661
  derived and/or modified sequence opt4 from hemagglutinin__InfluenzaA__AFM72543

SEQ ID NO: 161664 - RNA, 1698 nt, Artificial Sequence
  derived and/or modified sequence opt4 from hemagglutinin__InfluenzaA__AFM72554
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcagacugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagccuggagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcaaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacgaggugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161665 - RNA, 1701 nt, Artificial Sequence
  derived and/or modified sequence opt4 from hemagglutinin__InfluenzaA__AFM72565
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcagcugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccccuacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161666 - RNA, 1701 nt, Artificial Sequence
  derived and/or modified sequence opt4 from hemagglutinin__InfluenzaA__AFM72576
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcagcugcaucagaggcagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccccuacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161667 - RNA, 1698 nt, Artificial Sequence
  derived and/or modified sequence opt4 from hemagglutinin__InfluenzaA__AFM72799
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacaaccacaacggcaagcugugccugcugaagggcaaggccccccugcagcugggcaacugcagcguggccggcuggauccugggcaaccccgagugcggccugcugaucagcaaggagagcuggagcuacaucguggagagacccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcaaccagaugacccuguaccacaaggagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacguguggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugagcagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161668 - RNA, 1698 nt, Artificial Sequence; identical to SEQ ID NO: 161667
  derived and/or modified sequence opt4 from hemagglutinin__InfluenzaA__AFM72810

SEQ ID NO: 161669 - RNA, 1698 nt, Artificial Sequence; identical to SEQ ID NO: 161667
  derived and/or modified sequence opt4 from hemagglutinin__InfluenzaA__AFM72821

SEQ ID NO: 161670 - RNA, 1701 nt, Artificial Sequence
  derived and/or modified sequence opt4 from hemagglutinin__InfluenzaA__AFM72852
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcgacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaccuucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161671 - RNA, 1701 nt, Artificial Sequence
  derived and/or modified sequence opt4 from hemagglutinin__InfluenzaA__AFM72862
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaacagcuacaucaacgacaagggcaaggaggugcuggugcuguggggcauccaccaccccagcaccagcgccgaccagcagagccuguaccagaacgccgacgccuacguguucgugggcagcagcagauacagcaagaccuucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161672 - RNA, 1701 nt, Artificial Sequence
  derived and/or modified sequence opt4 from hemagglutinin__InfluenzaA__AFM72872
augaagaccaucaucgcccugagcuacacccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccccuacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161673 - RNA, 1701 nt, Artificial Sequence
  derived and/or modified sequence opt4 from hemagglutinin__InfluenzaA__AFM72883
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccgugaccgacaaggaccagaucuuccuguacgcccaggccagcggcagaaucaccgugagcaccaagagaagccagcagaccgugauccccaacaucggcagcagacccagagugagaaacauccccaccagaaucagcaucuacuggaccaucgugaagcccggcgacauccugcugaucaacagcaccggcaaccugaucgcccccagaggcuacuucaagaugcagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161674 - RNA, 1701 nt, Artificial Sequence
  derived and/or modified sequence opt4 from hemagglutinin__InfluenzaA__AFM72894
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccagcugaacuucaaguaccccgcccugaacgugaccaugcccaacaacgagcaguucgacaagcuguacaucuggggcgugcaccaccccgugaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaugcagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161675 - RNA, 1701 nt, Artificial Sequence
  derived and/or modified sequence opt4 from hemagglutinin__InfluenzaA__AFM72916
augaagaccaucaucgcccugagcuacauccugugccugguguucgcccagaagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccccuacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcggcugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugguuccuguggaucagcuucgccaucagcugcuuccugcugugcguggcccugcugggcuucaucaugugggccugccagaagggcaacaucagaugcaacaucugcaucuga

SEQ ID NO: 161676 - RNA, 1701 nt, Artificial Sequence
  derived and/or modified sequence opt4 from hemagglutinin__InfluenzaA__AFM72927
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaccagccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaucggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161677 - RNA, 1701 nt, Artificial Sequence
  derived and/or modified sequence opt4 from hemagglutinin__InfluenzaA__AFM72938
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaccagccuguacgcccaggccagcggcagaaucaccgugagcaccaagagaagccagcagaccgugauccccaacaucggcagcagacccagagugagaaacaaccccagcagaaucagcaucuacuggaccaucgugaagcccggcgacauccugcugaucaacagcaucggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161678 - RNA, 1701 nt, Artificial Sequence
  derived and/or modified sequence opt4 from hemagglutinin__InfluenzaA__AFM72949
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccagcugaaguucaaguaccccgcccugaacgugaccaugcccaacaacgagcaguucgacaagcuguacaucuggggcgugcaccaccccggcaccgacaacgaccagaccagccuguacgcccaggccagcggcagaaucaccgugagcaccaagagaagccagcagaccgugauccccaacaucggcagcagacccagagugagaaacaaccccagcagaaucagcaucuacuggaccaucgugaagcccggcgacauccugcugaucaacagcaucggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161679 - RNA, 1701 nt, Artificial Sequence
  derived and/or modified sequence opt4 from hemagglutinin__InfluenzaA__AFM72960
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaaguggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaccagccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaucggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161680 - RNA, 1701 nt, Artificial Sequence
  derived and/or modified sequence opt4 from hemagglutinin__InfluenzaA__AFM72971
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaaguggaccggcgugacccagaacggcaccagcagcgccugcaucagaagaagcaacaacagcuucuucagcagacugaacuggcugacccagcugaacuucaaguaccccgcccugaacgugaccaugcccaacaacgagcaguucgacaagcuguacaucuggggcgugcaccaccccggcaccgacaacgaccagaccagccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaucggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161681 - RNA, 1701 nt, Artificial Sequence
  derived and/or modified sequence opt4 from hemagglutinin__InfluenzaA__AFM72982
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacagcgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccccuacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacaucaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagccuggccaucagcugcuuccugcugugcguggcccugcugggcuucaucaugugggccugccagaagggcaacaucagaugcaacaucugcaucuga

SEQ ID NO: 161682 - RNA, 1701 nt, Artificial Sequence
  derived and/or modified sequence opt4 from hemagglutinin__InfluenzaA__AFM72993
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcgccggcgagaucugcgacagcccccaccagauccuggacggcgagaacugcacccugaucgacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcugcaccccggcaccuacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161683 - RNA, 1701 nt, Artificial Sequence
  derived and/or modified sequence opt4 from hemagglutinin__InfluenzaA__AFM73004
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcgccggcgagaucugcgacagcccccaccagauccuggacggcgagaacugcacccugaucgacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcugcaccccggcaccuacaaggaccagaucuuccuguacgcccaggccagcggcagagugaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuucuuccugugcguggcccugcugggcuucaucaugugggccugccagaagggcaacaucagaugcaacaucugcaucuga

SEQ ID NO: 161684 - RNA, 1701 nt, Artificial Sequence
  derived and/or modified sequence opt4 from hemagglutinin__InfluenzaA__AFM73015
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161685 - RNA, 1701 nt, Artificial Sequence
  derived and/or modified sequence opt4 from hemagglutinin__InfluenzaA__AFM73025
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgacgaccagcagagccuguaccagaacgccgacaccuacguguucgugggcaccagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161686 - RNA, 1701 nt, Artificial Sequence; identical to SEQ ID NO: 161685
  derived and/or modified sequence opt4 from hemagglutinin__InfluenzaA__AFM73035

SEQ ID NO: 161687 - RNA, 1701 nt, Artificial Sequence
  derived and/or modified sequence opt4 from hemagglutinin__InfluenzaA__AFM73045
augaaggccauccugguggugcugcuguacaccuucgccaccgccaacgccgacacccugugcaucggcuaccacgccaacaacagcaccgacaccguggacaccgugcuggagagaaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgagagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161688 - RNA, 1701 nt, Artificial Sequence
  derived and/or modified sequence opt4 from hemagglutinin__InfluenzaA__AFM73055
augaaggccauccugguggugcugcuguacaccuucgccaccgccaacgccgacacccugugcaucggcuaccacgccaacaacagcaccgacaccguggacaccgugcuggagagaaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcugguggagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161689 - RNA, 1701 nt, Artificial Sequence
  derived and/or modified sequence opt4 from hemagglutinin__InfluenzaA__AFM73065
augaaggccauccugguggugcugcuguacaccuucgccaccgccaacgccgacacccugugcaucggcuaccacgccaacaacagcaccgacaccguggacaccgugcuggagagaaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaaggagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161690 - RNA, 1701 nt, Artificial Sequence; identical to SEQ ID NO: 153435
  derived and/or modified sequence opt4 from hemagglutinin__InfluenzaA__AFM73477

SEQ ID NO: 161691 - RNA, 1707 nt, Artificial Sequence
  derived and/or modified sequence opt4 from hemagglutinin__InfluenzaA__AFM78567
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccaccaacgaccugugcuaccccggcagcuucaacgacuacgaggagcugaagcaccugcugagcagaaucaaccacuucgagaagauccagaucauccccaagagcagcuggagcgaccacgaggccagcagcggcgugagcagcgccugccccuaccugggcagccccagcuucuucagaaacgugguguggcugaucaagaagaacagcaccuaccccaccaucaagaagagcuacaacaacaccaaccaggaggaccugcuggugcuguggggcauccaccaccccaacgacgccgccgagcagaccagacuguaccagaaccccaccaccuacaucagcaucggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcaucagaaacggcaccuacaacuacccccaguacagcgaggaggccagacugaagagagaggagaucagcggcgugaagcuggagagcaucggcaccuaccagauccugagcaucuacagcaccguggccagcagccuggcccuggccaucaugauggccggccugagccuguggaugugcagcaacggcagccugcagugcagaaucugcaucuga

SEQ ID NO: 161692 - RNA, 1701 nt, Artificial Sequence
  derived and/or modified sequence opt4 from hemagglutinin__InfluenzaA__AFM78646
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagggccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161693 - RNA, 1698 nt, Artificial Sequence
  derived and/or modified sequence opt4 from hemagglutinin__InfluenzaA__AFM85179
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcugauccuguggggcgugcaccacccccccaacaucggcgaccagagaacccuguacuacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaucagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaaguucgagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161694 - RNA, 1701 nt, Artificial Sequence
  derived and/or modified sequence opt4 from hemagglutinin__InfluenzaA__AFN11846
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaagagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161695 - RNA, 1701 nt, Artificial Sequence; identical to SEQ ID NO: 156050
  derived and/or modified sequence opt4 from hemagglutinin__InfluenzaA__AFN17371

SEQ ID NO: 161696 - RNA, 1701 nt, Artificial Sequence; identical to SEQ ID NO: 155189
  derived and/or modified sequence opt4 from hemagglutinin__InfluenzaA__AFN17381

SEQ ID NO: 161697 - RNA, 1701 nt, Artificial Sequence; identical to SEQ ID NO: 155189
  derived and/or modified sequence opt4 from hemagglutinin__InfluenzaA__AFN17391

SEQ ID NO: 161698 - RNA, 1701 nt, Artificial Sequence; identical to SEQ ID NO: 155189
  derived and/or modified sequence opt4 from hemagglutinin__InfluenzaA__AFN17401

SEQ ID NO: 161699 - RNA, 1701 nt, Artificial Sequence; identical to SEQ ID NO: 155189
  derived and/or modified sequence opt4 from hemagglutinin__InfluenzaA__AFN17411

SEQ ID NO: 161700 - RNA, 1701 nt, Artificial Sequence; identical to SEQ ID NO: 155189
  derived and/or modified sequence opt4 from hemagglutinin__InfluenzaA__AFN17421

SEQ ID NO: 161701 - RNA, 1701 nt, Artificial Sequence; identical to SEQ ID NO: 155280
  derived and/or modified sequence opt4 from hemagglutinin__InfluenzaA__AFN17431

SEQ ID NO: 161702 - RNA, 1701 nt, Artificial Sequence
  derived and/or modified sequence opt4 from hemagglutinin__InfluenzaA__AFN17441
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaaggccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161703 - RNA, 1701 nt, Artificial Sequence; identical to SEQ ID NO: 157744
  derived and/or modified sequence opt4 from hemagglutinin__InfluenzaA__AFN17451

SEQ ID NO: 161704 - RNA, 1701 nt, Artificial Sequence; identical to SEQ ID NO: 156031
  derived and/or modified sequence opt4 from hemagglutinin__InfluenzaA__AFN17467

SEQ ID NO: 161705 - RNA, 1701 nt, Artificial Sequence; identical to SEQ ID NO: 155189
  derived and/or modified sequence opt4 from hemagglutinin__InfluenzaA__AFN17477

SEQ ID NO: 161706 - RNA, 1701 nt, Artificial Sequence; identical to SEQ ID NO: 156050
  derived and/or modified sequence opt4 from hemagglutinin__InfluenzaA__AFN17487

SEQ ID NO: 161707 - RNA, 1701 nt, Artificial Sequence; identical to SEQ ID NO: 155189
  derived and/or modified sequence opt4 from hemagglutinin__InfluenzaA__AFN17497

SEQ ID NO: 161708 - RNA, 1701 nt, Artificial Sequence; identical to SEQ ID NO: 155189
  derived and/or modified sequence opt4 from hemagglutinin__InfluenzaA__AFN17507

SEQ ID NO: 161709 - RNA, 1701 nt, Artificial Sequence; identical to SEQ ID NO: 156031
  derived and/or modified sequence opt4 from hemagglutinin__InfluenzaA__AFN17517

SEQ ID NO: 161710 - RNA, 1701 nt, Artificial Sequence; identical to SEQ ID NO: 156050
  derived and/or modified sequence opt4 from hemagglutinin__InfluenzaA__AFN17527

SEQ ID NO: 161711 - RNA, 1701 nt, Artificial Sequence; identical to SEQ ID NO: 155189
  derived and/or modified sequence opt4 from hemagglutinin__InfluenzaA__AFN17537

SEQ ID NO: 161712 - RNA, 1701 nt, Artificial Sequence; identical to SEQ ID NO: 155431
  derived and/or modified sequence opt4 from hemagglutinin__InfluenzaA__AFN17547

SEQ ID NO: 161713 - RNA, 1701 nt, Artificial Sequence; identical to SEQ ID NO: 156720
  derived and/or modified sequence opt4 from hemagglutinin__InfluenzaA__AFN17557

SEQ ID NO: 161714 - RNA, 1701 nt, Artificial Sequence; identical to SEQ ID NO: 156031
  derived and/or modified sequence opt4 from hemagglutinin__InfluenzaA__AFN17567

SEQ ID NO: 161715 - RNA, 1701 nt, Artificial Sequence; identical to SEQ ID NO: 155431
  derived and/or modified sequence opt4 from hemagglutinin__InfluenzaA__AFN17574

SEQ ID NO: 161716 - RNA, 1701 nt, Artificial Sequence; identical to SEQ ID NO: 155189
  derived and/or modified sequence opt4 from hemagglutinin__InfluenzaA__AFN17580

SEQ ID NO: 161717 - RNA, 1701 nt, Artificial Sequence; identical to SEQ ID NO: 155189
  derived and/or modified sequence opt4 from hemagglutinin__InfluenzaA__AFN17586

SEQ ID NO: 161718 - RNA, 1701 nt, Artificial Sequence; identical to SEQ ID NO: 156050
  derived and/or modified sequence opt4 from hemagglutinin__InfluenzaA__AFN17595

SEQ ID NO: 161719 - RNA, 1701 nt, Artificial Sequence; identical to SEQ ID NO: 155189
  derived and/or modified sequence opt4 from hemagglutinin__InfluenzaA__AFN17605

SEQ ID NO: 161720 - RNA, 1701 nt, Artificial Sequence; identical to SEQ ID NO: 155189
  derived and/or modified sequence opt4 from hemagglutinin__InfluenzaA__AFN17615

SEQ ID NO: 161721 - RNA, 1701 nt, Artificial Sequence; identical to SEQ ID NO: 155189
  derived and/or modified sequence opt4 from hemagglutinin__InfluenzaA__AFN17625

SEQ ID NO: 161722 - RNA, 1701 nt, Artificial Sequence; identical to SEQ ID NO: 155189
  derived and/or modified sequence opt4 from hemagglutinin__InfluenzaA__AFN17635

SEQ ID NO: 161723 - RNA, 1701 nt, Artificial Sequence
  derived and/or modified sequence opt4 from hemagglutinin__InfluenzaA__AFN17645
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagaguggagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161724 - RNA, 1701 nt, Artificial Sequence; identical to SEQ ID NO: 156050
  derived and/or modified sequence opt4 from hemagglutinin__InfluenzaA__AFN17655

SEQ ID NO: 161725 - RNA, 1701 nt, Artificial Sequence; identical to SEQ ID NO: 156050
  derived and/or modified sequence opt4 from hemagglutinin__InfluenzaA__AFN17665

SEQ ID NO: 161726 - RNA, 1701 nt, Artificial Sequence
  derived and/or modified sequence opt4 from hemagglutinin__InfluenzaA__AFN17675
augaaggccauccugaucgugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcgagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161727 - RNA, 1701 nt, Artificial Sequence
  derived and/or modified sequence opt4 from hemagglutinin__InfluenzaA__AFN17685
augaaggccauccugguggugcugcuguacaccuucgccaccgccaacgccgacacccugugcaucggcuaccacgccaacaacagcaccgacaccguggacaccauccuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccagagacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161728 - RNA, 1701 nt, Artificial Sequence; identical to SEQ ID NO: 155189
  derived and/or modified sequence opt4 from hemagglutinin__InfluenzaA__AFN17695

SEQ ID NO: 161729 - RNA, 1701 nt, Artificial Sequence; identical to SEQ ID NO: 155189
  derived and/or modified sequence opt4 from hemagglutinin__InfluenzaA__AFN17705

SEQ ID NO: 161730 - RNA, 1701 nt, Artificial Sequence; identical to SEQ ID NO: 155818
  derived and/or modified sequence opt4 from hemagglutinin__InfluenzaA__AFN17715

SEQ ID NO: 161731 - RNA, 1701 nt, Artificial Sequence
  derived and/or modified sequence opt4 from hemagglutinin__InfluenzaA__AFN17725
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagaccccaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161732 - RNA, 1701 nt, Artificial Sequence; identical to SEQ ID NO: 155189
  derived and/or modified sequence opt4 from hemagglutinin__InfluenzaA__AFN17735

SEQ ID NO: 161733 - RNA, 1701 nt, Artificial Sequence; identical to SEQ ID NO: 155189
  derived and/or modified sequence opt4 from hemagglutinin__InfluenzaA__AFN17742

SEQ ID NO: 161734 - RNA, 1701 nt, Artificial Sequence; identical to SEQ ID NO: 155189
  derived and/or modified sequence opt4 from hemagglutinin__InfluenzaA__AFN17748

SEQ ID NO: 161735 - RNA, 1701 nt, Artificial Sequence; identical to SEQ ID NO: 155189
  derived and/or modified sequence opt4 from hemagglutinin__InfluenzaA__AFN17757

SEQ ID NO: 161736 - RNA, 1701 nt, Artificial Sequence; identical to SEQ ID NO: 155818
  derived and/or modified sequence opt4 from hemagglutinin__InfluenzaA__AFN17767

SEQ ID NO: 161737 - RNA, 1701 nt, Artificial Sequence; identical to SEQ ID NO: 160199
  derived and/or modified sequence opt4 from hemagglutinin__InfluenzaA__AFN17774

SEQ ID NO: 161738 - RNA, 1701 nt, Artificial Sequence; identical to SEQ ID NO: 155189
  derived and/or modified sequence opt4 from hemagglutinin__InfluenzaA__AFN17783

SEQ ID NO: 161739 - RNA, 1701 nt, Artificial Sequence; identical to SEQ ID NO: 155818
  derived and/or modified sequence opt4 from hemagglutinin__InfluenzaA__AFN17793

SEQ ID NO: 161740 - RNA, 1701 nt, Artificial Sequence; identical to SEQ ID NO: 155189
  derived and/or modified sequence opt4 from hemagglutinin__InfluenzaA__AFN17803

SEQ ID NO: 161741 - RNA, 1701 nt, Artificial Sequence; identical to SEQ ID NO: 155189
  derived and/or modified sequence opt4 from hemagglutinin__InfluenzaA__AFN17813

SEQ ID NO: 161742 - RNA, 1701 nt, Artificial Sequence
  derived and/or modified sequence opt4 from hemagglutinin__InfluenzaA__AFN17823
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcgagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161743 - RNA, 1701 nt, Artificial Sequence
  derived and/or modified sequence opt4 from hemagglutinin__InfluenzaA__AFN17833
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugccccaacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161744 - RNA, 1701 nt, Artificial Sequence; identical to SEQ ID NO: 159698
  derived and/or modified sequence opt4 from hemagglutinin__InfluenzaA__AFN17843

SEQ ID NO: 161745 - RNA, 1701 nt, Artificial Sequence; identical to SEQ ID NO: 155189
  derived and/or modified sequence opt4 from hemagglutinin__InfluenzaA__AFN17853

SEQ ID NO: 161746 - RNA, 1701 nt, Artificial Sequence; identical to SEQ ID NO: 155431
  derived and/or modified sequence opt4 from hemagglutinin__InfluenzaA__AFN17863

SEQ ID NO: 161747 - RNA, 1701 nt, Artificial Sequence
  derived and/or modified sequence opt4 from hemagglutinin__InfluenzaA__AFN17873
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccggcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccugaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161748 - RNA, 1701 nt, Artificial Sequence
  derived and/or modified sequence opt4 from hemagglutinin__InfluenzaA__AFN17883
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccugaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161749 - RNA, 1701 nt, Artificial Sequence; identical to SEQ ID NO: 155189
  derived and/or modified sequence opt4 from hemagglutinin__InfluenzaA__AFN17893

SEQ ID NO: 161750 - RNA, 1701 nt, Artificial Sequence
  derived and/or modified sequence opt4 from hemagglutinin__InfluenzaA__AFN17903
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgagagcaacaagggcgugaccgccgccugcccccacgccggcgccaagagcuucuacaagaaccugaucuggcuggugaagaagggcaacagcuaccccaagcugagcaagagcuacgugaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161751 - RNA, 1701 nt, Artificial Sequence; identical to SEQ ID NO: 155542
  derived and/or modified sequence opt4 from hemagglutinin__InfluenzaA__AFN17919

SEQ ID NO: 161752 - RNA, 1701 nt, Artificial Sequence; identical to SEQ ID NO: 155431
  derived and/or modified sequence opt4 from hemagglutinin__InfluenzaA__AFN17929

SEQ ID NO: 161753 - RNA, 1701 nt, Artificial Sequence; identical to SEQ ID NO: 161447
  derived and/or modified sequence opt4 from hemagglutinin__InfluenzaA__AFN17939

SEQ ID NO: 161754 - RNA, 1701 nt, Artificial Sequence; identical to SEQ ID NO: 156050
  derived and/or modified sequence opt4 from hemagglutinin__InfluenzaA__AFN17949

SEQ ID NO: 161755 - RNA, 1701 nt, Artificial Sequence
  derived and/or modified sequence opt4 from hemagglutinin__InfluenzaA__AFN17959
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacgugaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161756 - RNA, 1701 nt, Artificial Sequence; identical to SEQ ID NO: 156871
  derived and/or modified sequence opt4 from hemagglutinin__InfluenzaA__AFN17969

SEQ ID NO: 161757 - RNA, 1701 nt, Artificial Sequence; identical to SEQ ID NO: 156050
  derived and/or modified sequence opt4 from hemagglutinin__InfluenzaA__AFN17979

SEQ ID NO: 161758 - RNA, 1701 nt, Artificial Sequence
  derived and/or modified sequence opt4 from hemagglutinin__InfluenzaA__AFN17989
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucggcaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161759 - RNA, 1701 nt, Artificial Sequence; identical to SEQ ID NO: 155189
  derived and/or modified sequence opt4 from hemagglutinin__InfluenzaA__AFN17999

SEQ ID NO: 161760 - RNA, 1701 nt, Artificial Sequence
  derived and/or modified sequence opt4 from hemagglutinin__InfluenzaA__AFN18019
augaaggccauccugguggugcugcuguacaccuucgccaccgccaaggccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161761 - RNA, 1701 nt, Artificial Sequence; identical to SEQ ID NO: 156050
  derived and/or modified sequence opt4 from hemagglutinin__InfluenzaA__AFN18039

SEQ ID NO: 161762 - RNA, 1701 nt, Artificial Sequence; identical to SEQ ID NO: 155189
  derived and/or modified sequence opt4 from hemagglutinin__InfluenzaA__AFN18049

SEQ ID NO: 161763 - RNA, 1701 nt, Artificial Sequence
  derived and/or modified sequence opt4 from hemagglutinin__InfluenzaA__AFN18059
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacgccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161764 - RNA, 1701 nt, Artificial Sequence; identical to SEQ ID NO: 155189
  derived and/or modified sequence opt4 from hemagglutinin__InfluenzaA__AFN18078

SEQ ID NO: 161765 - RNA, 1701 nt, Artificial Sequence
  derived and/or modified sequence opt4 from hemagglutinin__InfluenzaA__AFN18088
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggugagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161766 - RNA, 1701 nt, Artificial Sequence
  derived and/or modified sequence opt4 from hemagglutinin__InfluenzaA__AFN18098
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcaucgccccccugcaccugggcaagugcaacaucgccggcuggauccugggcaaccccgagugcgagagccugagcaccgccagcagcuggagcuacaucguggagaccagcagcagcgacaacggcaccugcuaccccggcaacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccguggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161767 - RNA, 1701 nt, Artificial Sequence
  derived and/or modified sequence opt4 from hemagglutinin__InfluenzaA__AFN18105
augaaggccauccugaucgugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaacugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161768 - RNA, 1701 nt, Artificial Sequence; identical to SEQ ID NO: 155431
  derived and/or modified sequence opt4 from hemagglutinin__InfluenzaA__AFN18107

SEQ ID NO: 161769 - RNA, 1701 nt, Artificial Sequence; identical to SEQ ID NO: 161763
  derived and/or modified sequence opt4 from hemagglutinin__InfluenzaA__AFN18117

SEQ ID NO: 161770 - RNA, 1701 nt, Artificial Sequence; identical to SEQ ID NO: 155189
  derived and/or modified sequence opt4 from hemagglutinin__InfluenzaA__AFN18119

SEQ ID NO: 161771 - RNA, 1701 nt, Artificial Sequence
  derived and/or modified sequence opt4 from hemagglutinin__InfluenzaA__AFN18121
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccagaagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggugagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161772 - RNA, 1701 nt, Artificial Sequence; identical to SEQ ID NO: 161763
  derived and/or modified sequence opt4 from hemagglutinin__InfluenzaA__AFN18133

SEQ ID NO: 161773 - RNA, 1701 nt, Artificial Sequence; identical to SEQ ID NO: 161447
  derived and/or modified sequence opt4 from hemagglutinin__InfluenzaA__AFN18135

SEQ ID NO: 161774 - RNA, 1701 nt, Artificial Sequence; identical to SEQ ID NO: 156031
  derived and/or modified sequence opt4 from hemagglutinin__InfluenzaA__AFN18137

SEQ ID NO: 161775 - RNA, 1701 nt, Artificial Sequence
  derived and/or modified sequence opt4 from hemagglutinin__InfluenzaA__AFN18139
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagggccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161776 - RNA, 1701 nt, Artificial Sequence; identical to SEQ ID NO: 161771
  derived and/or modified sequence opt4 from hemagglutinin__InfluenzaA__AFN18141

SEQ ID NO: 161777 - RNA, 1701 nt, Artificial Sequence; identical to SEQ ID NO: 156050
  derived and/or modified sequence opt4 from hemagglutinin__InfluenzaA__AFN18148

SEQ ID NO: 161778 - RNA, 1701 nt, Artificial Sequence; identical to SEQ ID NO: 156353
  derived and/or modified sequence opt4 from hemagglutinin__InfluenzaA__AFN18155

SEQ ID NO: 161779 - RNA, 1701 nt, Artificial Sequence
  derived and/or modified sequence opt4 from hemagglutinin__InfluenzaA__AFN18157
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacgccuucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161780 - RNA, 1701 nt, Artificial Sequence
  derived and/or modified sequence opt4 from hemagglutinin__InfluenzaA__AFN18159
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcagcaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161781 - RNA, 1701 nt, Artificial Sequence
  derived and/or modified sequence opt4 from hemagglutinin__InfluenzaA__AFN18164
augaaggccauccugguggugcugcuguacaccuucgccaccaccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugaucgugcccagauacgccuucgccauggagagaaacgccggcagcggcaucaucaucagcaacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggagcugaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccguguacagcaccguggccagcagccuggugcugguggugagccugggcgccaucagcuucuggaugugcagcaacggcagccugcagugcagaaucugcaucuga

SEQ ID NO: 161782 - RNA, 1701 nt, Artificial Sequence
  derived and/or modified sequence opt4 from hemagglutinin__InfluenzaA__AFN18171
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacagcggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaagugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugaaggacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161783 - RNA, 1701 nt, Artificial Sequence
  derived and/or modified sequence opt4 from hemagglutinin__InfluenzaA__AFN18176
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161784 - RNA, 1701 nt, Artificial Sequence
  derived and/or modified sequence opt4 from hemagglutinin__InfluenzaA__AFN18183
augaaggccauccugguggugcugcuguacaccuucgccaccgccaacgccgacacccugugcaucggcuaccacgccaacaacagcaccgacaccguggacaccauccuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugauggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161785 - RNA, 1701 nt, Artificial Sequence; identical to SEQ ID NO: 156741
  derived and/or modified sequence opt4 from hemagglutinin__InfluenzaA__AFN18195

SEQ ID NO: 161786 - RNA, 1701 nt, Artificial Sequence; identical to SEQ ID NO: 155189
  derived and/or modified sequence opt4 from hemagglutinin__InfluenzaA__AFN18200

SEQ ID NO: 161787 - RNA, 1701 nt, Artificial Sequence
  derived and/or modified sequence opt4 from hemagglutinin__InfluenzaA__AFN18207
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagagccugaucuggcuggugaagaagggcaacagcuaccccaagcugagcaagagcuacaucaacgacaagggcagagaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161788 - RNA, 1701 nt, Artificial Sequence
  derived and/or modified sequence opt4 from hemagglutinin__InfluenzaA__AFN18214
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 161789 - RNA, 1701 nt, Artificial Sequence; identical to SEQ ID NO: 157744
  derived and/or modified sequence opt4 from hemagglutinin__InfluenzaA__AFN18224

SEQ ID NO: 161790 - RNA, 1701 nt, Artificial Sequence; identical to SEQ ID NO: 156741
  derived and/or modified sequence opt4 from hemagglutinin__InfluenzaA__AFN18231

SEQ ID NO: 161791 - RNA, 1701 nt, Artificial Sequence
  derived and/or modified sequence opt4 from hemagglutinin__InfluenzaA__AFN18233
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcagaaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaagcuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161792 - RNA, 1701 nt, Artificial Sequence
  derived and/or modified sequence opt4 from hemagglutinin__InfluenzaA__AFN18243
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161793 - RNA, 1701 nt, Artificial Sequence; identical to SEQ ID NO: 161278
  derived and/or modified sequence opt4 from hemagglutinin__InfluenzaA__AFN18245

SEQ ID NO: 161794 - RNA, 1701 nt, Artificial Sequence; identical to SEQ ID NO: 157744
  derived and/or modified sequence opt4 from hemagglutinin__InfluenzaA__AFN18255

SEQ ID NO: 161795 - RNA, 1701 nt, Artificial Sequence; identical to SEQ ID NO: 161792
  derived and/or modified sequence opt4 from hemagglutinin__InfluenzaA__AFN18260

SEQ ID NO: 161796 - RNA, 1701 nt, Artificial Sequence; identical to SEQ ID NO: 161792
  derived and/or modified sequence opt4 from hemagglutinin__InfluenzaA__AFN18267

SEQ ID NO: 161797 - RNA, 1701 nt, Artificial Sequence
  derived and/or modified sequence opt4 from hemagglutinin__InfluenzaA__AFN18269
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagaaguucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161798 - RNA, 1701 nt, Artificial Sequence; identical to SEQ ID NO: 156353
  derived and/or modified sequence opt4 from hemagglutinin__InfluenzaA__AFN18271

SEQ ID NO: 161799 - RNA, 1701 nt, Artificial Sequence; identical to SEQ ID NO: 156741
  derived and/or modified sequence opt4 from hemagglutinin__InfluenzaA__AFN18273

SEQ ID NO: 161800 - RNA, 1701 nt, Artificial Sequence; identical to SEQ ID NO: 156353
  derived and/or modified sequence opt4 from hemagglutinin__InfluenzaA__AFN18280

SEQ ID NO: 161801 - RNA, 1701 nt, Artificial Sequence; identical to SEQ ID NO: 155987
  derived and/or modified sequence opt4 from hemagglutinin__InfluenzaA__AFN18303

SEQ ID NO: 161802 - RNA, 1701 nt, Artificial Sequence
  derived and/or modified sequence opt4 from hemagglutinin__InfluenzaA__AFN18305
augaaggccauccugguggugcugcuguacaccuucgccaccgccaacgccgacacccugugcaucggcuaccacgccaacaacagcaccgacaccguggacaccgugcuggagaagaacgugaccgugacccacagcgccaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccugggcaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161803 - RNA, 1701 nt, Artificial Sequence
  derived and/or modified sequence opt4 from hemagglutinin__InfluenzaA__AFN18307
augaaggccauccugguggugcugcuguacaccuucgccgccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacaccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161804 - RNA, 1701 nt, Artificial Sequence
  derived and/or modified sequence opt4 from hemagglutinin__InfluenzaA__AFN18312
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcaucaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcuggugaucagccugggcgccaucagcuucuggaugugcagcaacggcagccugcagugcagaaucugcaucuga

SEQ ID NO: 161805 - RNA, 1701 nt, Artificial Sequence; identical to SEQ ID NO: 157554
  derived and/or modified sequence opt4 from hemagglutinin__InfluenzaA__AFN18319

SEQ ID NO: 161806 - RNA, 1701 nt, Artificial Sequence; identical to SEQ ID NO: 159651
  derived and/or modified sequence opt4 from hemagglutinin__InfluenzaA__AFN18324

SEQ ID NO: 161807 - RNA, 1701 nt, Artificial Sequence; identical to SEQ ID NO: 155542
  derived and/or modified sequence opt4 from hemagglutinin__InfluenzaA__AFN18334

SEQ ID NO: 161808 - RNA, 1701 nt, Artificial Sequence; identical to SEQ ID NO: 157305
  derived and/or modified sequence opt4 from hemagglutinin__InfluenzaA__AFN18344

SEQ ID NO: 161809 - RNA, 1701 nt, Artificial Sequence; identical to SEQ ID NO: 155189
  derived and/or modified sequence opt4 from hemagglutinin__InfluenzaA__AFN18354

SEQ ID NO: 161810 - RNA, 1701 nt, Artificial Sequence
  derived and/or modified sequence opt4 from hemagglutinin__InfluenzaA__AFN18364
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccugaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161811 - RNA, 1701 nt, Artificial Sequence; identical to SEQ ID NO: 155189
  derived and/or modified sequence opt4 from hemagglutinin__InfluenzaA__AFN18374

SEQ ID NO: 161812 - RNA, 1701 nt, Artificial Sequence
  derived and/or modified sequence opt4 from hemagglutinin__InfluenzaA__AFN18381
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccuggugaagcccggcgacaagaucaccuucgaggccaccggcaaccugguggugcccagauacgccuucgccauggagagaaacgccggcagcggcaucaucaucagcgacacccccgugcaggacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161813 - RNA, 1701 nt, Artificial Sequence
  derived and/or modified sequence opt4 from hemagglutinin__InfluenzaA__AFN18390
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaagaucagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161814 - RNA, 1701 nt, Artificial Sequence
  derived and/or modified sequence opt4 from hemagglutinin__InfluenzaA__AFN18400
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcgugaccccccugcaccugggcaagugcaacaucgccggcuggauccugggcaaccccgagugcgagagccugagcaaggccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgugggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161815 - RNA, 1701 nt, Artificial Sequence; identical to SEQ ID NO: 155280
  derived and/or modified sequence opt4 from hemagglutinin__InfluenzaA__AFN18410

SEQ ID NO: 161816 - RNA, 1701 nt, Artificial Sequence; identical to SEQ ID NO: 155189
  derived and/or modified sequence opt4 from hemagglutinin__InfluenzaA__AFN18420

SEQ ID NO: 161817 - RNA, 1701 nt, Artificial Sequence
  derived and/or modified sequence opt4 from hemagglutinin__InfluenzaA__AFN18430
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggagaacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggugagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161818 - RNA, 1701 nt, Artificial Sequence; identical to SEQ ID NO: 155189
  derived and/or modified sequence opt4 from hemagglutinin__InfluenzaA__AFN18440

SEQ ID NO: 161819 - RNA, 1701 nt, Artificial Sequence; identical to SEQ ID NO: 155189
  derived and/or modified sequence opt4 from hemagglutinin__InfluenzaA__AFN18450

SEQ ID NO: 161820 - RNA, 1701 nt, Artificial Sequence; identical to SEQ ID NO: 157744
  derived and/or modified sequence opt4 from hemagglutinin__InfluenzaA__AFN18460

SEQ ID NO: 161821 - RNA, 1701 nt, Artificial Sequence; identical to SEQ ID NO: 156050
  derived and/or modified sequence opt4 from hemagglutinin__InfluenzaA__AFN18470

SEQ ID NO: 161822 - RNA, 1701 nt, Artificial Sequence; identical to SEQ ID NO: 155280
  derived and/or modified sequence opt4 from hemagglutinin__InfluenzaA__AFN18480

SEQ ID NO: 161823 - RNA, 1701 nt, Artificial Sequence; identical to SEQ ID NO: 156050
  derived and/or modified sequence opt4 from hemagglutinin__InfluenzaA__AFN18490

SEQ ID NO: 161824 - RNA, 1701 nt, Artificial Sequence; identical to SEQ ID NO: 155189
  derived and/or modified sequence opt4 from hemagglutinin__InfluenzaA__AFN18497

SEQ ID NO: 161825 - RNA, 1701 nt, Artificial Sequence; identical to SEQ ID NO: 155189
  derived and/or modified sequence opt4 from hemagglutinin__InfluenzaA__AFN18512

SEQ ID NO: 161826 - RNA, 1701 nt, Artificial Sequence
  derived and/or modified sequence opt4 from hemagglutinin__InfluenzaA__AFN18519
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaaggagaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161827 - RNA, 1701 nt, Artificial Sequence
  derived and/or modified sequence opt4 from hemagglutinin__InfluenzaA__AFN18521
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggugagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcggcgaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161828 - RNA, 1701 nt, Artificial Sequence; identical to SEQ ID NO: 155189
  derived and/or modified sequence opt4 from hemagglutinin__InfluenzaA__AFN18528

SEQ ID NO: 161829 - RNA, 1701 nt, Artificial Sequence; identical to SEQ ID NO: 155189
  derived and/or modified sequence opt4 from hemagglutinin__InfluenzaA__AFN18531

SEQ ID NO: 161830 - RNA, 1701 nt, Artificial Sequence; identical to SEQ ID NO: 157786
  derived and/or modified sequence opt4 from hemagglutinin__InfluenzaA__AFN18543

SEQ ID NO: 161831 - RNA, 1701 nt, Artificial Sequence; identical to SEQ ID NO: 160071
  derived and/or modified sequence opt4 from hemagglutinin__InfluenzaA__AFN18545

SEQ ID NO: 161832 - RNA, 1701 nt, Artificial Sequence; identical to SEQ ID NO: 156050
  derived and/or modified sequence opt4 from hemagglutinin__InfluenzaA__AFN18550

SEQ ID NO: 161833 - RNA, 1701 nt, Artificial Sequence
  derived and/or modified sequence opt4 from hemagglutinin__InfluenzaA__AFN18557
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgcccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161834 - RNA, 1701 nt, Artificial Sequence
  derived and/or modified sequence opt4 from hemagglutinin__InfluenzaA__AFN18559
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagaaccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161835 - RNA, 1701 nt, Artificial Sequence; identical to SEQ ID NO: 156055
  derived and/or modified sequence opt4 from hemagglutinin__InfluenzaA__AFN18561

SEQ ID NO: 161836 - RNA, 1701 nt, Artificial Sequence; identical to SEQ ID NO: 156291
  derived and/or modified sequence opt4 from hemagglutinin__InfluenzaA__AFN18563

SEQ ID NO: 161837 - RNA, 1701 nt, Artificial Sequence
  derived and/or modified sequence opt4 from hemagglutinin__InfluenzaA__AFN18565
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggugagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaauggagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161838 - RNA, 1701 nt, Artificial Sequence
  derived and/or modified sequence opt4 from hemagglutinin__InfluenzaA__AFN18570
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgugagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161839 - RNA, 1701 nt, Artificial Sequence; identical to SEQ ID NO: 155189
  derived and/or modified sequence opt4 from hemagglutinin__InfluenzaA__AFN18580

SEQ ID NO: 161840 - RNA, 1701 nt, Artificial Sequence; identical to SEQ ID NO: 155431
  derived and/or modified sequence opt4 from hemagglutinin__InfluenzaA__AFN18590

SEQ ID NO: 161841 - RNA, 1701 nt, Artificial Sequence
  derived and/or modified sequence opt4 from hemagglutinin__InfluenzaA__AFN18600
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagaaccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacgccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161842 - RNA, 1701 nt, Artificial Sequence; identical to SEQ ID NO: 155189
  derived and/or modified sequence opt4 from hemagglutinin__InfluenzaA__AFN18610

SEQ ID NO: 161843 - RNA, 1701 nt, Artificial Sequence
  derived and/or modified sequence opt4 from hemagglutinin__InfluenzaA__AFN18617
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggugagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagagcgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaagagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161844 - RNA, 1701 nt, Artificial Sequence; identical to SEQ ID NO: 156050
  derived and/or modified sequence opt4 from hemagglutinin__InfluenzaA__AFN18622

SEQ ID NO: 161845 - RNA, 1701 nt, Artificial Sequence; identical to SEQ ID NO: 155189
  derived and/or modified sequence opt4 from hemagglutinin__InfluenzaA__AFN18629

SEQ ID NO: 161846 - RNA, 1701 nt, Artificial Sequence; identical to SEQ ID NO: 155431
  derived and/or modified sequence opt4 from hemagglutinin__InfluenzaA__AFN18634

SEQ ID NO: 161847 - RNA, 1701 nt, Artificial Sequence
  derived and/or modified sequence opt4 from hemagglutinin__InfluenzaA__AFN18644
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggugagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagagcgccaucgacgagaucaccaacaaggugaacagcgugaucgagaaggugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161848 - RNA, 1701 nt, Artificial Sequence; identical to SEQ ID NO: 156050
  derived and/or modified sequence opt4 from hemagglutinin__InfluenzaA__AFN18654

SEQ ID NO: 161849 - RNA, 1701 nt, Artificial Sequence; identical to SEQ ID NO: 155189
  derived and/or modified sequence opt4 from hemagglutinin__InfluenzaA__AFN18664

SEQ ID NO: 161850 - RNA, 1701 nt, Artificial Sequence; identical to SEQ ID NO: 155431
  derived and/or modified sequence opt4 from hemagglutinin__InfluenzaA__AFN18674

SEQ ID NO: 161851 - RNA, 1701 nt, Artificial Sequence; identical to SEQ ID NO: 155189
  derived and/or modified sequence opt4 from hemagglutinin__InfluenzaA__AFN18684

SEQ ID NO: 161852 - RNA, 1701 nt, Artificial Sequence; identical to SEQ ID NO: 156050
  derived and/or modified sequence opt4 from hemagglutinin__InfluenzaA__AFN18694

SEQ ID NO: 161853 - RNA, 1701 nt, Artificial Sequence
  derived and/or modified sequence opt4 from hemagglutinin__InfluenzaA__AFN18704
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggugagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagagcgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161854 - RNA, 1701 nt, Artificial Sequence; identical to SEQ ID NO: 157423
  derived and/or modified sequence opt4 from hemagglutinin__InfluenzaA__AFN18714

SEQ ID NO: 161855 - RNA, 1701 nt, Artificial Sequence; identical to SEQ ID NO: 155189
  derived and/or modified sequence opt4 from hemagglutinin__InfluenzaA__AFN18721

SEQ ID NO: 161856 - RNA, 1701 nt, Artificial Sequence; identical to SEQ ID NO: 157855
  derived and/or modified sequence opt4 from hemagglutinin__InfluenzaA__AFN18725

SEQ ID NO: 161857 - RNA, 1701 nt, Artificial Sequence
  derived and/or modified sequence opt4 from hemagglutinin__InfluenzaA__AFN18735
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagacccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161858 - RNA, 1701 nt, Artificial Sequence; identical to SEQ ID NO: 155189
  derived and/or modified sequence opt4 from hemagglutinin__InfluenzaA__AFN18742

SEQ ID NO: 161859 - RNA, 1701 nt, Artificial Sequence; identical to SEQ ID NO: 156291
  derived and/or modified sequence opt4 from hemagglutinin__InfluenzaA__AFN18747

SEQ ID NO: 161860 - RNA, 1701 nt, Artificial Sequence
  derived and/or modified sequence opt4 from hemagglutinin__InfluenzaA__AFN18757
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccuggccgugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161861 - RNA, 1701 nt, Artificial Sequence; identical to SEQ ID NO: 155189
  derived and/or modified sequence opt4 from hemagglutinin__InfluenzaA__AFN18767

SEQ ID NO: 161862 - RNA, 1701 nt, Artificial Sequence; identical to SEQ ID NO: 161853
  derived and/or modified sequence opt4 from hemagglutinin__InfluenzaA__AFN18774

SEQ ID NO: 161863 - RNA, 1701 nt, Artificial Sequence; identical to SEQ ID NO: 155189
  derived and/or modified sequence opt4 from hemagglutinin__InfluenzaA__AFN18776

SEQ ID NO: 161864 - RNA, 1701 nt, Artificial Sequence; identical to SEQ ID NO: 156055
  derived and/or modified sequence opt4 from hemagglutinin__InfluenzaA__AFN18778

SEQ ID NO: 161865 - RNA, 1701 nt, Artificial Sequence; identical to SEQ ID NO: 155189
  derived and/or modified sequence opt4 from hemagglutinin__InfluenzaA__AFN18784

SEQ ID NO: 161866 - RNA, 1701 nt, Artificial Sequence; identical to SEQ ID NO: 156055
  derived and/or modified sequence opt4 from hemagglutinin__InfluenzaA__AFN18789

SEQ ID NO: 161867 - RNA, 1701 nt, Artificial Sequence; identical to SEQ ID NO: 155189
  derived and/or modified sequence opt4 from hemagglutinin__InfluenzaA__AFN18799

SEQ ID NO: 161868 - RNA, 1701 nt, Artificial Sequence; identical to SEQ ID NO: 155189
  derived and/or modified sequence opt4 from hemagglutinin__InfluenzaA__AFN18809

SEQ ID NO: 161869 - RNA, 1701 nt, Artificial Sequence; identical to SEQ ID NO: 156291
  derived and/or modified sequence opt4 from hemagglutinin__InfluenzaA__AFN18816

SEQ ID NO: 161870 - RNA, 1701 nt, Artificial Sequence; identical to SEQ ID NO: 155189
  derived and/or modified sequence opt4 from hemagglutinin__InfluenzaA__AFN18818

SEQ ID NO: 161871 - RNA, 1701 nt, Artificial Sequence
  derived and/or modified sequence opt4 from hemagglutinin__InfluenzaA__AFN18820
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaacugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161872 - RNA, 1701 nt, Artificial Sequence; identical to SEQ ID NO: 155189
  derived and/or modified sequence opt4 from hemagglutinin__InfluenzaA__AFN18822

SEQ ID NO: 161873 - RNA, 1701 nt, Artificial Sequence
  derived and/or modified sequence opt4 from hemagglutinin__InfluenzaA__AFN18824
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugagacuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161874 - RNA, 1701 nt, Artificial Sequence; identical to SEQ ID NO: 161797
  derived and/or modified sequence opt4 from hemagglutinin__InfluenzaA__AFN18826

SEQ ID NO: 161875 - RNA, 1701 nt, Artificial Sequence
  derived and/or modified sequence opt4 from hemagglutinin__InfluenzaA__AFN18828
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaucaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161876 - RNA, 1701 nt, Artificial Sequence; identical to SEQ ID NO: 161860
  derived and/or modified sequence opt4 from hemagglutinin__InfluenzaA__AFN18830

SEQ ID NO: 161877 - RNA, 1701 nt, Artificial Sequence; identical to SEQ ID NO: 155189
  derived and/or modified sequence opt4 from hemagglutinin__InfluenzaA__AFN18832

SEQ ID NO: 161878 - RNA, 1701 nt, Artificial Sequence; identical to SEQ ID NO: 156055
  derived and/or modified sequence opt4 from hemagglutinin__InfluenzaA__AFN18834

SEQ ID NO: 161879 - RNA, 1701 nt, Artificial Sequence
  derived and/or modified sequence opt4 from hemagglutinin__InfluenzaA__AFN18849
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacguggacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161880 - RNA, 1701 nt, Artificial Sequence
  derived and/or modified sequence opt4 from hemagglutinin__InfluenzaA__AFN18856
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggagaacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161881 - RNA, 1701 nt, Artificial Sequence; identical to SEQ ID NO: 156050
  derived and/or modified sequence opt4 from hemagglutinin__InfluenzaA__AFN18858

SEQ ID NO: 161882 - RNA, 1701 nt, Artificial Sequence
  derived and/or modified sequence opt4 from hemagglutinin__InfluenzaA__AFN18860
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcagccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaauggacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161883 - RNA, 1701 nt, Artificial Sequence
  derived and/or modified sequence opt4 from hemagglutinin__InfluenzaA__AFN18865
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacaccagcgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161884 - RNA, 1701 nt, Artificial Sequence
  derived and/or modified sequence opt4 from hemagglutinin__InfluenzaA__AFN18875
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgcccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161885 - RNA, 1701 nt, Artificial Sequence
  derived and/or modified sequence opt4 from hemagglutinin__InfluenzaA__AFN18885
augaaggccauccugaucgugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccaaccugcccuuccagaacauccaccccaucaccaucggcaagugccccaaguacgugaagagcaccaagcugagacuggccaccggccugagaaacgugcccagcacccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcaagaucugcaucuga

SEQ ID NO: 161886 - RNA, 1701 nt, Artificial Sequence; identical to SEQ ID NO: 155189
  derived and/or modified sequence opt4 from hemagglutinin__InfluenzaA__AFN18892

SEQ ID NO: 161887 - RNA, 1701 nt, Artificial Sequence; identical to SEQ ID NO: 155431
  derived and/or modified sequence opt4 from hemagglutinin__InfluenzaA__AFN18894

SEQ ID NO: 161888 - RNA, 1701 nt, Artificial Sequence; identical to SEQ ID NO: 161853
  derived and/or modified sequence opt4 from hemagglutinin__InfluenzaA__AFN18903

SEQ ID NO: 161889 - RNA, 1701 nt, Artificial Sequence; identical to SEQ ID NO: 156291
  derived and/or modified sequence opt4 from hemagglutinin__InfluenzaA__AFN18910

SEQ ID NO: 161890 - RNA, 1701 nt, Artificial Sequence
  derived and/or modified sequence opt4 from hemagglutinin__InfluenzaA__AFN18912
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacaccagcgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161891 - RNA, 1701 nt, Artificial Sequence; identical to SEQ ID NO: 156291
  derived and/or modified sequence opt4 from hemagglutinin__InfluenzaA__AFN18917

SEQ ID NO: 161892 - RNA, 1701 nt, Artificial Sequence; identical to SEQ ID NO: 155189
  derived and/or modified sequence opt4 from hemagglutinin__InfluenzaA__AFN18927

SEQ ID NO: 161893 - RNA, 1701 nt, Artificial Sequence; identical to SEQ ID NO: 157855
  derived and/or modified sequence opt4 from hemagglutinin__InfluenzaA__AFN18937

SEQ ID NO: 161894 - RNA, 1701 nt, Artificial Sequence
  derived and/or modified sequence opt4 from hemagglutinin__InfluenzaA__AFN18952
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacagaaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161895 - RNA, 1701 nt, Artificial Sequence
  derived and/or modified sequence opt4 from hemagglutinin__InfluenzaA__AFN18957
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaaccacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161896 - RNA, 1701 nt, Artificial Sequence; identical to SEQ ID NO: 161278
  derived and/or modified sequence opt4 from hemagglutinin__InfluenzaA__AFN18964

SEQ ID NO: 161897 - RNA, 1701 nt, Artificial Sequence
  derived and/or modified sequence opt4 from hemagglutinin__InfluenzaA__AFN18974
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcaugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaagaaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgacgaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161898 - RNA, 1701 nt, Artificial Sequence; identical to SEQ ID NO: 156741
  derived and/or modified sequence opt4 from hemagglutinin__InfluenzaA__AFN18979

SEQ ID NO: 161899 - RNA, 1701 nt, Artificial Sequence
  derived and/or modified sequence opt4 from hemagglutinin__InfluenzaA__AFN18982
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccaacagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucaacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161900 - RNA, 1701 nt, Artificial Sequence; identical to SEQ ID NO: 161792
  derived and/or modified sequence opt4 from hemagglutinin__InfluenzaA__AFN18984

SEQ ID NO: 161901 - RNA, 1701 nt, Artificial Sequence; identical to SEQ ID NO: 155189
  derived and/or modified sequence opt4 from hemagglutinin__InfluenzaA__AFN18986

SEQ ID NO: 161902 - RNA, 1701 nt, Artificial Sequence; identical to SEQ ID NO: 155189
  derived and/or modified sequence opt4 from hemagglutinin__InfluenzaA__AFN18988

SEQ ID NO: 161903 - RNA, 1701 nt, Artificial Sequence; identical to SEQ ID NO: 156353
  derived and/or modified sequence opt4 from hemagglutinin__InfluenzaA__AFN18993

SEQ ID NO: 161904 - RNA, 1701 nt, Artificial Sequence; identical to SEQ ID NO: 156353
  derived and/or modified sequence opt4 from hemagglutinin__InfluenzaA__AFN18999

SEQ ID NO: 161905 - RNA, 1701 nt, Artificial Sequence; identical to SEQ ID NO: 155987
  derived and/or modified sequence opt4 from hemagglutinin__InfluenzaA__AFN19006

SEQ ID NO: 161906 - RNA, 1701 nt, Artificial Sequence; identical to SEQ ID NO: 155189
  derived and/or modified sequence opt4 from hemagglutinin__InfluenzaA__AFN19026

SEQ ID NO: 161907 - RNA, 1701 nt, Artificial Sequence; identical to SEQ ID NO: 156329
  derived and/or modified sequence opt4 from hemagglutinin__InfluenzaA__AFN19036

SEQ ID NO: 161908 - RNA, 1701 nt, Artificial Sequence; identical to SEQ ID NO: 155189
  derived and/or modified sequence opt4 from hemagglutinin__InfluenzaA__AFN19043

SEQ ID NO: 161909 - RNA, 1701 nt, Artificial Sequence; identical to SEQ ID NO: 155189
  derived and/or modified sequence opt4 from hemagglutinin__InfluenzaA__AFN19053

SEQ ID NO: 161910 - RNA, 1701 nt, Artificial Sequence; identical to SEQ ID NO: 155189
  derived and/or modified sequence opt4 from hemagglutinin__InfluenzaA__AFN19063

SEQ ID NO: 161911 - RNA, 1701 nt, Artificial Sequence; identical to SEQ ID NO: 155189
  derived and/or modified sequence opt4 from hemagglutinin__InfluenzaA__AFN19070

SEQ ID NO: 161912 - RNA, 1701 nt, Artificial Sequence
  derived and/or modified sequence opt4 from hemagglutinin__InfluenzaA__AFN19076
augaaggccauccugguggugcugcuguacaccuucgccaccgccaacgccgacacccugugcaucggcuaccacgccaacaacagcaccgacaccguggacaccgugcuggagaaggacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161913 - RNA, 1701 nt, Artificial Sequence; identical to SEQ ID NO: 155189
  derived and/or modified sequence opt4 from hemagglutinin__InfluenzaA__AFN19082

SEQ ID NO: 161914 - RNA, 1701 nt, Artificial Sequence; identical to SEQ ID NO: 155189
  derived and/or modified sequence opt4 from hemagglutinin__InfluenzaA__AFN19088

SEQ ID NO: 161915 - RNA, 1701 nt, Artificial Sequence; identical to SEQ ID NO: 155189
  derived and/or modified sequence opt4 from hemagglutinin__InfluenzaA__AFN19097

SEQ ID NO: 161916 - RNA, 1701 nt, Artificial Sequence; identical to SEQ ID NO: 155189
  derived and/or modified sequence opt4 from hemagglutinin__InfluenzaA__AFN19104

SEQ ID NO: 161917 - RNA, 1701 nt, Artificial Sequence; identical to SEQ ID NO: 155189
  derived and/or modified sequence opt4 from hemagglutinin__InfluenzaA__AFN19113

SEQ ID NO: 161918 - RNA, 1701 nt, Artificial Sequence; identical to SEQ ID NO: 155189
  derived and/or modified sequence opt4 from hemagglutinin__InfluenzaA__AFN19119

SEQ ID NO: 161919 - RNA, 1701 nt, Artificial Sequence; identical to SEQ ID NO: 157700
  derived and/or modified sequence opt4 from hemagglutinin__InfluenzaA__AFN19125

SEQ ID NO: 161920 - RNA, 1701 nt, Artificial Sequence; identical to SEQ ID NO: 155189
  derived and/or modified sequence opt4 from hemagglutinin__InfluenzaA__AFN19134

SEQ ID NO: 161921 - RNA, 1701 nt, Artificial Sequence; identical to SEQ ID NO: 155189
  derived and/or modified sequence opt4 from hemagglutinin__InfluenzaA__AFN19144

SEQ ID NO: 161922 - RNA, 1701 nt, Artificial Sequence; identical to SEQ ID NO: 157744
  derived and/or modified sequence opt4 from hemagglutinin__InfluenzaA__AFN19154

SEQ ID NO: 161923 - RNA, 1701 nt, Artificial Sequence; identical to SEQ ID NO: 155189
  derived and/or modified sequence opt4 from hemagglutinin__InfluenzaA__AFN19164

SEQ ID NO: 161924 - RNA, 1701 nt, Artificial Sequence; identical to SEQ ID NO: 155189
  derived and/or modified sequence opt4 from hemagglutinin__InfluenzaA__AFN19174

SEQ ID NO: 161925 - RNA, 1701 nt, Artificial Sequence; identical to SEQ ID NO: 155189
  derived and/or modified sequence opt4 from hemagglutinin__InfluenzaA__AFN19184

SEQ ID NO: 161926 - RNA, 1701 nt, Artificial Sequence; identical to SEQ ID NO: 155189
  derived and/or modified sequence opt4 from hemagglutinin__InfluenzaA__AFN19194

SEQ ID NO: 161927 - RNA, 1701 nt, Artificial Sequence; identical to SEQ ID NO: 155189
  derived and/or modified sequence opt4 from hemagglutinin__InfluenzaA__AFN19203

SEQ ID NO: 161928 - RNA, 1701 nt, Artificial Sequence; identical to SEQ ID NO: 155189
  derived and/or modified sequence opt4 from hemagglutinin__InfluenzaA__AFN19213

SEQ ID NO: 161929 - RNA, 1701 nt, Artificial Sequence; identical to SEQ ID NO: 155189
  derived and/or modified sequence opt4 from hemagglutinin__InfluenzaA__AFN19223

SEQ ID NO: 161930 - RNA, 1701 nt, Artificial Sequence; identical to SEQ ID NO: 155189
  derived and/or modified sequence opt4 from hemagglutinin__InfluenzaA__AFN19233

SEQ ID NO: 161931 - RNA, 1701 nt, Artificial Sequence
  derived and/or modified sequence opt4 from hemagglutinin__InfluenzaA__AFN19243
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcaggacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161932 - RNA, 1701 nt, Artificial Sequence; identical to SEQ ID NO: 157305
  derived and/or modified sequence opt4 from hemagglutinin__InfluenzaA__AFN19250

SEQ ID NO: 161933 - RNA, 1701 nt, Artificial Sequence; identical to SEQ ID NO: 155189
  derived and/or modified sequence opt4 from hemagglutinin__InfluenzaA__AFN19259

SEQ ID NO: 161934 - RNA, 1701 nt, Artificial Sequence; identical to SEQ ID NO: 155189
  derived and/or modified sequence opt4 from hemagglutinin__InfluenzaA__AFN19269

SEQ ID NO: 161935 - RNA, 1701 nt, Artificial Sequence; identical to SEQ ID NO: 155189
  derived and/or modified sequence opt4 from hemagglutinin__InfluenzaA__AFN19279

SEQ ID NO: 161936 - RNA, 1701 nt, Artificial Sequence; identical to SEQ ID NO: 156050
  derived and/or modified sequence opt4 from hemagglutinin__InfluenzaA__AFN19286

SEQ ID NO: 161937 - RNA, 1701 nt, Artificial Sequence; identical to SEQ ID NO: 155189
  derived and/or modified sequence opt4 from hemagglutinin__InfluenzaA__AFN19295

SEQ ID NO: 161938 - RNA, 1701 nt, Artificial Sequence; identical to SEQ ID NO: 155189
  derived and/or modified sequence opt4 from hemagglutinin__InfluenzaA__AFN19305

SEQ ID NO: 161939 - RNA, 1701 nt, Artificial Sequence; identical to SEQ ID NO: 156055
  derived and/or modified sequence opt4 from hemagglutinin__InfluenzaA__AFN19315

SEQ ID NO: 161940 - RNA, 1701 nt, Artificial Sequence; identical to SEQ ID NO: 155189
  derived and/or modified sequence opt4 from hemagglutinin__InfluenzaA__AFN19325

SEQ ID NO: 161941 - RNA, 1701 nt, Artificial Sequence; identical to SEQ ID NO: 155189
  derived and/or modified sequence opt4 from hemagglutinin__InfluenzaA__AFN19335

SEQ ID NO: 161942 - RNA, 1701 nt, Artificial Sequence; identical to SEQ ID NO: 155189
  derived and/or modified sequence opt4 from hemagglutinin__InfluenzaA__AFN19344

SEQ ID NO: 161943 - RNA, 1701 nt, Artificial Sequence
  derived and/or modified sequence opt4 from hemagglutinin__InfluenzaA__AFN19351
augaagaccaucaucgcccugagcuacauccugugccugguguucgcccagaagcugcccggcaacgacaacagcauggccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacgugagaugcaacaucugcaucuga

SEQ ID NO: 161944 - RNA, 1701 nt, Artificial Sequence; identical to SEQ ID NO: 161594
  derived and/or modified sequence opt4 from hemagglutinin__InfluenzaA__AFN19355

SEQ ID NO: 161945 - RNA, 1701 nt, Artificial Sequence; identical to SEQ ID NO: 161594
  derived and/or modified sequence opt4 from hemagglutinin__InfluenzaA__AFN19357

SEQ ID NO: 161946 - RNA, 1701 nt, Artificial Sequence; identical to SEQ ID NO: 161594
  derived and/or modified sequence opt4 from hemagglutinin__InfluenzaA__AFN19361

SEQ ID NO: 161947 - RNA, 1701 nt, Artificial Sequence
  derived and/or modified sequence opt4 from hemagglutinin__InfluenzaA__AFN19363
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161948 - RNA, 1701 nt, Artificial Sequence; identical to SEQ ID NO: 159502
  derived and/or modified sequence opt4 from hemagglutinin__InfluenzaA__AFN19365

SEQ ID NO: 161949 - RNA, 1701 nt, Artificial Sequence
  derived and/or modified sequence opt4 from hemagglutinin__InfluenzaA__AFN19367
augaagaccaucaucgcccugagcuacauccugugccugguguucgcccagaagcugcccgagaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgugaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161950 - RNA, 1701 nt, Artificial Sequence
  derived and/or modified sequence opt4 from hemagglutinin__InfluenzaA__AFN19369
augaagaccaucaucgcccugagcuacauccugugccugguguucgcccagaagcugcccgagaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgugaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161951 - RNA, 1701 nt, Artificial Sequence
  derived and/or modified sequence opt4 from hemagglutinin__InfluenzaA__AFN19373
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161952 - RNA, 1701 nt, Artificial Sequence; identical to SEQ ID NO: 161594
  derived and/or modified sequence opt4 from hemagglutinin__InfluenzaA__AFN19375

SEQ ID NO: 161953 - RNA, 1701 nt, Artificial Sequence
  derived and/or modified sequence opt4 from hemagglutinin__InfluenzaA__AFN19377
augaagaccaucaucgcccugagcuacauccugugccugguguucgcccagaagcugcccgagaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgugaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaacggcaacaucagaugcaacaucugcaucuga

SEQ ID NO: 161954 - RNA, 1701 nt, Artificial Sequence; identical to SEQ ID NO: 161594
  derived and/or modified sequence opt4 from hemagglutinin__InfluenzaA__AFN19379

SEQ ID NO: 161955 - RNA, 1701 nt, Artificial Sequence; identical to SEQ ID NO: 161951
  derived and/or modified sequence opt4 from hemagglutinin__InfluenzaA__AFN19381

SEQ ID NO: 161956 - RNA, 1701 nt, Artificial Sequence; identical to SEQ ID NO: 161950
  derived and/or modified sequence opt4 from hemagglutinin__InfluenzaA__AFN19383

SEQ ID NO: 161957 - RNA, 1701 nt, Artificial Sequence
  derived and/or modified sequence opt4 from hemagglutinin__InfluenzaA__AFN19385
augaagaccaucaucgcccugagcuacauccugugccugguguucgcccagaagcugcccgagaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgugaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgacaucuggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161958 - RNA, 1701 nt, Artificial Sequence; identical to SEQ ID NO: 161950
  derived and/or modified sequence opt4 from hemagglutinin__InfluenzaA__AFN19387

SEQ ID NO: 161959 - RNA, 1701 nt, Artificial Sequence; identical to SEQ ID NO: 161594
  derived and/or modified sequence opt4 from hemagglutinin__InfluenzaA__AFN19389

SEQ ID NO: 161960 - RNA, 1701 nt, Artificial Sequence; identical to SEQ ID NO: 161594
  derived and/or modified sequence opt4 from hemagglutinin__InfluenzaA__AFN19391

SEQ ID NO: 161961 - RNA, 1701 nt, Artificial Sequence
  derived and/or modified sequence opt4 from hemagglutinin__InfluenzaA__AFN19393
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcgccggcgagaucugcgacagcccccaccacauccuggacggcgagaacugcacccugaucgacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugagcaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161962 - RNA, 1701 nt, Artificial Sequence; identical to SEQ ID NO: 161950
  derived and/or modified sequence opt4 from hemagglutinin__InfluenzaA__AFN19397

SEQ ID NO: 161963 - RNA, 1701 nt, Artificial Sequence; identical to SEQ ID NO: 161594
  derived and/or modified sequence opt4 from hemagglutinin__InfluenzaA__AFN19399

SEQ ID NO: 161964 - RNA, 1701 nt, Artificial Sequence; identical to SEQ ID NO: 161950
  derived and/or modified sequence opt4 from hemagglutinin__InfluenzaA__AFN19401

SEQ ID NO: 161965 - RNA, 1701 nt, Artificial Sequence; identical to SEQ ID NO: 161594
  derived and/or modified sequence opt4 from hemagglutinin__InfluenzaA__AFN19403

SEQ ID NO: 161966 - RNA, 1701 nt, Artificial Sequence; identical to SEQ ID NO: 161950
  derived and/or modified sequence opt4 from hemagglutinin__InfluenzaA__AFN19405

SEQ ID NO: 161967 - RNA, 1701 nt, Artificial Sequence
  derived and/or modified sequence opt4 from hemagglutinin__InfluenzaA__AFN19407
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggagcggcgugacccagaacggcaccagcagcgccugcaugagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161968 - RNA, 1701 nt, Artificial Sequence
  derived and/or modified sequence opt4 from hemagglutinin__InfluenzaA__AFN19409
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161969 - RNA, 1701 nt, Artificial Sequence; identical to SEQ ID NO: 161950
  derived and/or modified sequence opt4 from hemagglutinin__InfluenzaA__AFN19411

SEQ ID NO: 161970 - RNA, 1701 nt, Artificial Sequence; identical to SEQ ID NO: 161594
  derived and/or modified sequence opt4 from hemagglutinin__InfluenzaA__AFN19413

SEQ ID NO: 161971 - RNA, 1701 nt, Artificial Sequence
  derived and/or modified sequence opt4 from hemagglutinin__InfluenzaA__AFN19415
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcgugaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161972 - RNA, 1701 nt, Artificial Sequence
  derived and/or modified sequence opt4 from hemagglutinin__InfluenzaA__AFN19417
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161973 - RNA, 1701 nt, Artificial Sequence
  derived and/or modified sequence opt4 from hemagglutinin__InfluenzaA__AFN19423
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161974 - RNA, 1701 nt, Artificial Sequence; identical to SEQ ID NO: 161950
  derived and/or modified sequence opt4 from hemagglutinin__InfluenzaA__AFN19425

SEQ ID NO: 161975 - RNA, 1701 nt, Artificial Sequence
  derived and/or modified sequence opt4 from hemagglutinin__InfluenzaA__AFN19437
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucagaaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacagaaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacuacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161976 - RNA, 1701 nt, Artificial Sequence
  derived and/or modified sequence opt4 from hemagglutinin__InfluenzaA__AFN19439
augaagaccaucaucgcccugagccacauccugugccugguguucgcccagaagcugcccgagaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaucaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagcccagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161977 - RNA, 1701 nt, Artificial Sequence; identical to SEQ ID NO: 161951
  derived and/or modified sequence opt4 from hemagglutinin__InfluenzaA__AFN19443

SEQ ID NO: 161978 - RNA, 1701 nt, Artificial Sequence
  derived and/or modified sequence opt4 from hemagglutinin__InfluenzaA__AFN19445
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugagacuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161979 - RNA, 1701 nt, Artificial Sequence; identical to SEQ ID NO: 161973
  derived and/or modified sequence opt4 from hemagglutinin__InfluenzaA__AFN19447

SEQ ID NO: 161980 - RNA, 1701 nt, Artificial Sequence
  derived and/or modified sequence opt4 from hemagglutinin__InfluenzaA__AFN19451
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaacggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161981 - RNA, 1701 nt, Artificial Sequence
  derived and/or modified sequence opt4 from hemagglutinin__InfluenzaA__AFN19453
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccaggugaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161982 - RNA, 1701 nt, Artificial Sequence; identical to SEQ ID NO: 161973
  derived and/or modified sequence opt4 from hemagglutinin__InfluenzaA__AFN19455

SEQ ID NO: 161983 - RNA, 1701 nt, Artificial Sequence; identical to SEQ ID NO: 161594
  derived and/or modified sequence opt4 from hemagglutinin__InfluenzaA__AFN19457

SEQ ID NO: 161984 - RNA, 1701 nt, Artificial Sequence; identical to SEQ ID NO: 161594
  derived and/or modified sequence opt4 from hemagglutinin__InfluenzaA__AFN19459

SEQ ID NO: 161985 - RNA, 1701 nt, Artificial Sequence; identical to SEQ ID NO: 161951
  derived and/or modified sequence opt4 from hemagglutinin__InfluenzaA__AFN19461

SEQ ID NO: 161986 - RNA, 1701 nt, Artificial Sequence
  derived and/or modified sequence opt4 from hemagglutinin__InfluenzaA__AFN19465
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaucggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcaucgcccugcugggcuucaucaugugggccugccagaagggcaacaucagaugcaacaucugcaucuga

SEQ ID NO: 161987 - RNA, 1701 nt, Artificial Sequence; identical to SEQ ID NO: 161973
  derived and/or modified sequence opt4 from hemagglutinin__InfluenzaA__AFN19467

SEQ ID NO: 161988 - RNA, 1701 nt, Artificial Sequence; identical to SEQ ID NO: 161981
  derived and/or modified sequence opt4 from hemagglutinin__InfluenzaA__AFN19469

SEQ ID NO: 161989 - RNA, 1701 nt, Artificial Sequence; identical to SEQ ID NO: 161594
  derived and/or modified sequence opt4 from hemagglutinin__InfluenzaA__AFN19471

SEQ ID NO: 161990 - RNA, 1701 nt, Artificial Sequence
  derived and/or modified sequence opt4 from hemagglutinin__InfluenzaA__AFN19473
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcggcagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161991 - RNA, 1701 nt, Artificial Sequence; identical to SEQ ID NO: 161973
  derived and/or modified sequence opt4 from hemagglutinin__InfluenzaA__AFN19475

SEQ ID NO: 161992 - RNA, 1701 nt, Artificial Sequence; identical to SEQ ID NO: 161594
  derived and/or modified sequence opt4 from hemagglutinin__InfluenzaA__AFN19477

SEQ ID NO: 161993 - RNA, 1701 nt, Artificial Sequence
  derived and/or modified sequence opt4 from hemagglutinin__InfluenzaA__AFN19479
augaagaccaucaucgcccugagcugcauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161994 - RNA, 1701 nt, Artificial Sequence; identical to SEQ ID NO: 161973
  derived and/or modified sequence opt4 from hemagglutinin__InfluenzaA__AFN19483

SEQ ID NO: 161995 - RNA, 1701 nt, Artificial Sequence; identical to SEQ ID NO: 159375
  derived and/or modified sequence opt4 from hemagglutinin__InfluenzaA__AFN19485

SEQ ID NO: 161996 - RNA, 1701 nt, Artificial Sequence; identical to SEQ ID NO: 161594
  derived and/or modified sequence opt4 from hemagglutinin__InfluenzaA__AFN19487

SEQ ID NO: 161997 - RNA, 1701 nt, Artificial Sequence
  derived and/or modified sequence opt4 from hemagglutinin__InfluenzaA__AFN19491
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161998 - RNA, 1701 nt, Artificial Sequence
  derived and/or modified sequence opt4 from hemagglutinin__InfluenzaA__AFN19493
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161999 - RNA, 1701 nt, Artificial Sequence
  derived and/or modified sequence opt4 from hemagglutinin__InfluenzaA__AFN19495
augaagaccaucaucgcccugagcuacauccugugccugguguucgcccagaagauccccggcaacgacaacagcaccgccacccugugccugggccaccacgccgugcccaacggcaccaucgugaagaccaucaccaacgaccagaucgaggugaccaacgccaccgagcuggugcagagcagcagcgccggcgagaucugcgacagcccccaccacauccuggacggcgagaacugcacccugaucgacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaccagcugcuuccugcugugcguggcccugcugggcuucaucaugugggccugccagaagggcaacaucagaugcaacaucugcaucuga

SEQ ID NO: 162000 - RNA, 1701 nt, Artificial Sequence
  derived and/or modified sequence opt4 from hemagglutinin__InfluenzaA__AFN19497
augaagaccaucaucgcccugagcuacauccugugccugguguucgcccagaagcugcccgagaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcaccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162001 - RNA, 1701 nt, Artificial Sequence; identical to SEQ ID NO: 161951
  derived and/or modified sequence opt4 from hemagglutinin__InfluenzaA__AFN19499

SEQ ID NO: 162002 - RNA, 1701 nt, Artificial Sequence; identical to SEQ ID NO: 161950
  derived and/or modified sequence opt4 from hemagglutinin__InfluenzaA__AFN19501

SEQ ID NO: 162003 - RNA, 1701 nt, Artificial Sequence; identical to SEQ ID NO: 159502
  derived and/or modified sequence opt4 from hemagglutinin__InfluenzaA__AFN19503

SEQ ID NO: 162004 - RNA, 1701 nt, Artificial Sequence; identical to SEQ ID NO: 161951
  derived and/or modified sequence opt4 from hemagglutinin__InfluenzaA__AFN19507

SEQ ID NO: 162005 - RNA, 1701 nt, Artificial Sequence; identical to SEQ ID NO: 161950
  derived and/or modified sequence opt4 from hemagglutinin__InfluenzaA__AFN19509

SEQ ID NO: 162006 - RNA, 1701 nt, Artificial Sequence; identical to SEQ ID NO: 161951
  derived and/or modified sequence opt4 from hemagglutinin__InfluenzaA__AFN19513

SEQ ID NO: 162007 - RNA, 1701 nt, Artificial Sequence; identical to SEQ ID NO: 161950
  derived and/or modified sequence opt4 from hemagglutinin__InfluenzaA__AFN19515

SEQ ID NO: 162008 - RNA, 1701 nt, Artificial Sequence; identical to SEQ ID NO: 161951
  derived and/or modified sequence opt4 from hemagglutinin__InfluenzaA__AFN19517

SEQ ID NO: 162009 - RNA, 1701 nt, Artificial Sequence; identical to SEQ ID NO: 161951
  derived and/or modified sequence opt4 from hemagglutinin__InfluenzaA__AFN19519

SEQ ID NO: 162010 - RNA, 1701 nt, Artificial Sequence; identical to SEQ ID NO: 161594
  derived and/or modified sequence opt4 from hemagglutinin__InfluenzaA__AFN19521

SEQ ID NO: 162011 - RNA, 1701 nt, Artificial Sequence; identical to SEQ ID NO: 161950
  derived and/or modified sequence opt4 from hemagglutinin__InfluenzaA__AFN19523

SEQ ID NO: 162012 - RNA, 1701 nt, Artificial Sequence
  derived and/or modified sequence opt4 from hemagglutinin__InfluenzaA__AFN19527
augaagaccaucaucgcccugagcuacacccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162013 - RNA, 1701 nt, Artificial Sequence
  derived and/or modified sequence opt4 from hemagglutinin__InfluenzaA__AFN19529
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162014 - RNA, 1701 nt, Artificial Sequence; identical to SEQ ID NO: 161594
  derived and/or modified sequence opt4 from hemagglutinin__InfluenzaA__AFN19531

SEQ ID NO: 162015 - RNA, 1701 nt, Artificial Sequence; identical to SEQ ID NO: 162013
  derived and/or modified sequence opt4 from hemagglutinin__InfluenzaA__AFN19533

SEQ ID NO: 162016 - RNA, 1701 nt, Artificial Sequence
  derived and/or modified sequence opt4 from hemagglutinin__InfluenzaA__AFN19535
augaagaccaucaucgcccugagcuacauccugugccugguguucgcccagaagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162017 - RNA, 1701 nt, Artificial Sequence; identical to SEQ ID NO: 161594
  derived and/or modified sequence opt4 from hemagglutinin__InfluenzaA__AFN19537

SEQ ID NO: 162018 - RNA, 1701 nt, Artificial Sequence; identical to SEQ ID NO: 161594
  derived and/or modified sequence opt4 from hemagglutinin__InfluenzaA__AFN19539

SEQ ID NO: 162019 - RNA, 1701 nt, Artificial Sequence; identical to SEQ ID NO: 161594
  derived and/or modified sequence opt4 from hemagglutinin__InfluenzaA__AFN19543

SEQ ID NO: 162020 - RNA, 1701 nt, Artificial Sequence
  derived and/or modified sequence opt4 from hemagglutinin__InfluenzaA__AFN19545
augaagaccaucaucgcccugagcuacauccugugccugguguucgcccagaagcugcccggcagcgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuucaagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162021 - RNA, 1701 nt, Artificial Sequence; identical to SEQ ID NO: 161594
  derived and/or modified sequence opt4 from hemagglutinin__InfluenzaA__AFN19547

SEQ ID NO: 162022 - RNA, 1701 nt, Artificial Sequence
  derived and/or modified sequence opt4 from hemagglutinin__InfluenzaA__AFN19549
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaagggcgagaucugcaacagcccccaccagauccuggacggcggcaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaugagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggacaucgagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162023 - RNA, 1701 nt, Artificial Sequence
  derived and/or modified sequence opt4 from hemagglutinin__InfluenzaA__AFN19551
augaagaccaucaucgcccugagcuacauccugugccugguguucgcccagaagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccacugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162024 - RNA, 1701 nt, Artificial Sequence; identical to SEQ ID NO: 161973
  derived and/or modified sequence opt4 from hemagglutinin__InfluenzaA__AFN19553

SEQ ID NO: 162025 - RNA, 1701 nt, Artificial Sequence; identical to SEQ ID NO: 161973
  derived and/or modified sequence opt4 from hemagglutinin__InfluenzaA__AFN19555

SEQ ID NO: 162026 - RNA, 1701 nt, Artificial Sequence; identical to SEQ ID NO: 161594
  derived and/or modified sequence opt4 from hemagglutinin__InfluenzaA__AFN19557

SEQ ID NO: 162027 - RNA, 1701 nt, Artificial Sequence; identical to SEQ ID NO: 161973
  derived and/or modified sequence opt4 from hemagglutinin__InfluenzaA__AFN19559

SEQ ID NO: 162028 - RNA, 1701 nt, Artificial Sequence; identical to SEQ ID NO: 161981
  derived and/or modified sequence opt4 from hemagglutinin__InfluenzaA__AFN19561

SEQ ID NO: 162029 - RNA, 1701 nt, Artificial Sequence
  derived and/or modified sequence opt4 from hemagglutinin__InfluenzaA__AFN19563
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaccagcugcuuccugcugugcguggcccugcugggcuucaucaugugggccugccagaagggcaacaucagaugcaacaucugcaucuga

SEQ ID NO: 162030 - RNA, 1701 nt, Artificial Sequence; identical to SEQ ID NO: 161951
  derived and/or modified sequence opt4 from hemagglutinin__InfluenzaA__AFN19565

SEQ ID NO: 162031 - RNA, 1701 nt, Artificial Sequence
  derived and/or modified sequence opt4 from hemagglutinin__InfluenzaA__AFN19567
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162032 - RNA, 1701 nt, Artificial Sequence; identical to SEQ ID NO: 161594
  derived and/or modified sequence opt4 from hemagglutinin__InfluenzaA__AFN19569

SEQ ID NO: 162033 - RNA, 1701 nt, Artificial Sequence
  derived and/or modified sequence opt4 from hemagglutinin__InfluenzaA__AFN19571
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacagccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucagaaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuacagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggaccuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162034 - RNA, 1701 nt, Artificial Sequence
  derived and/or modified sequence opt4 from hemagglutinin__InfluenzaA__AFN19573
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcaagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguacagcgcccugaacgugaccaugcccaacaaggagcaguucgacaagcuguacaucuggggcgugcaccaccccggcaccgacaaggaccagaucagccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaugcagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162035 - RNA, 1701 nt, Artificial Sequence
  derived and/or modified sequence opt4 from hemagglutinin__InfluenzaA__AFN19575
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacaacccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162036 - RNA, 1701 nt, Artificial Sequence; identical to SEQ ID NO: 161950
  derived and/or modified sequence opt4 from hemagglutinin__InfluenzaA__AFN19577

SEQ ID NO: 162037 - RNA, 1701 nt, Artificial Sequence; identical to SEQ ID NO: 161950
  derived and/or modified sequence opt4 from hemagglutinin__InfluenzaA__AFN19579

SEQ ID NO: 162038 - RNA, 1701 nt, Artificial Sequence; identical to SEQ ID NO: 161950
  derived and/or modified sequence opt4 from hemagglutinin__InfluenzaA__AFN19581

SEQ ID NO: 162039 - RNA, 1701 nt, Artificial Sequence; identical to SEQ ID NO: 161950
  derived and/or modified sequence opt4 from hemagglutinin__InfluenzaA__AFN19583

SEQ ID NO: 162040 - RNA, 1701 nt, Artificial Sequence
  derived and/or modified sequence opt4 from hemagglutinin__InfluenzaA__AFN19587
augaagaccaucaucgcccugagcuacauccugugccugguguucgcccagaagcugcccgagaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgugaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacgagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162041 - RNA, 1701 nt, Artificial Sequence; identical to SEQ ID NO: 161950
  derived and/or modified sequence opt4 from hemagglutinin__InfluenzaA__AFN19589

SEQ ID NO: 162042 - RNA, 1701 nt, Artificial Sequence
  derived and/or modified sequence opt4 from hemagglutinin__InfluenzaA__AFN19591
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaugagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaacggcaacaucagaugcaacaucugcaucuga

SEQ ID NO: 162043 - RNA, 1701 nt, Artificial Sequence; identical to SEQ ID NO: 161950
  derived and/or modified sequence opt4 from hemagglutinin__InfluenzaA__AFN19593

SEQ ID NO: 162044 - RNA, 1701 nt, Artificial Sequence; identical to SEQ ID NO: 161951
  derived and/or modified sequence opt4 from hemagglutinin__InfluenzaA__AFN19595

SEQ ID NO: 162045 - RNA, 1701 nt, Artificial Sequence; identical to SEQ ID NO: 161951
  derived and/or modified sequence opt4 from hemagglutinin__InfluenzaA__AFN19599

SEQ ID NO: 162046 - RNA, 1701 nt, Artificial Sequence; identical to SEQ ID NO: 162013
  derived and/or modified sequence opt4 from hemagglutinin__InfluenzaA__AFN19601

SEQ ID NO: 162047 - RNA, 1701 nt, Artificial Sequence; identical to SEQ ID NO: 161594
  derived and/or modified sequence opt4 from hemagglutinin__InfluenzaA__AFN19607

SEQ ID NO: 162048 - RNA, 1701 nt, Artificial Sequence; identical to SEQ ID NO: 161950
  derived and/or modified sequence opt4 from hemagglutinin__InfluenzaA__AFN19609

SEQ ID NO: 162049 - RNA, 1701 nt, Artificial Sequence
  derived and/or modified sequence opt4 from hemagglutinin__InfluenzaA__AFN19611
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucguggagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162050 - RNA, 1701 nt, Artificial Sequence; identical to SEQ ID NO: 161973
  derived and/or modified sequence opt4 from hemagglutinin__InfluenzaA__AFN19613

SEQ ID NO: 162051 - RNA, 1701 nt, Artificial Sequence; identical to SEQ ID NO: 161951
  derived and/or modified sequence opt4 from hemagglutinin__InfluenzaA__AFN19617

SEQ ID NO: 162052 - RNA, 1701 nt, Artificial Sequence
  derived and/or modified sequence opt4 from hemagglutinin__InfluenzaA__AFN19619
augaagaccaucaucgcccugagccacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcaagcccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 162053 - RNA, 1701 nt, Artificial Sequence; identical to SEQ ID NO: 162013
  derived and/or modified sequence opt4 from hemagglutinin__InfluenzaA__AFN19623

SEQ ID NO: 162054 - RNA, 1701 nt, Artificial Sequence; identical to SEQ ID NO: 161950
  derived and/or modified sequence opt4 from hemagglutinin__InfluenzaA__AFN19629

SEQ ID NO: 162055 - RNA, 1701 nt, Artificial Sequence
  derived and/or modified sequence opt4 from hemagglutinin__InfluenzaA__AFN19631
augaagaccaucaucgcccugagcuacauccugugccugguguucgcccagaagcugcccgagaacgacuacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaucaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaccagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagcccagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162056 - RNA, 1701 nt, Artificial Sequence
  derived and/or modified sequence opt4 from hemagglutinin__InfluenzaA__AFN19633
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccaucagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162057 - RNA, 1701 nt, Artificial Sequence
  derived and/or modified sequence opt4 from hemagglutinin__InfluenzaA__AFN19635
augaagaccaucaucgcccugagcuacauccugugccugguguucgcccagaagcugcccgagaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaucaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagcccagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162058 - RNA, 1701 nt, Artificial Sequence; identical to SEQ ID NO: 162057
  derived and/or modified sequence opt4 from hemagglutinin__InfluenzaA__AFN19637

SEQ ID NO: 162059 - RNA, 1701 nt, Artificial Sequence; identical to SEQ ID NO: 161594
  derived and/or modified sequence opt4 from hemagglutinin__InfluenzaA__AFN19639

SEQ ID NO: 162060 - RNA, 1701 nt, Artificial Sequence; identical to SEQ ID NO: 162013
  derived and/or modified sequence opt4 from hemagglutinin__InfluenzaA__AFN19641

SEQ ID NO: 162061 - RNA, 1701 nt, Artificial Sequence; identical to SEQ ID NO: 162057
  derived and/or modified sequence opt4 from hemagglutinin__InfluenzaA__AFN19643

SEQ ID NO: 162062 - RNA, 1701 nt, Artificial Sequence; identical to SEQ ID NO: 161594
  derived and/or modified sequence opt4 from hemagglutinin__InfluenzaA__AFN19645

SEQ ID NO: 162063 - RNA, 1701 nt, Artificial Sequence
  derived and/or modified sequence opt4 from hemagglutinin__InfluenzaA__AFN19647
augaagaccaucaucgcccugagcuacauccugugccugguguucgcccagaagcugcccgagaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgugaacugcacccugaucgacgcccugcugggcgacccccagugcgacggcuuccagaacaagaagugggaccuguucguggagagaagcaaggccuacagcaacugcuaccccuacgacgugcccgacuacgccagccugaagagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162064 - RNA, 1701 nt, Artificial Sequence
  derived and/or modified sequence opt4 from hemagglutinin__InfluenzaA__AFN19649
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucagcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162065 - RNA, 1701 nt, Artificial Sequence; identical to SEQ ID NO: 162057
  derived and/or modified sequence opt4 from hemagglutinin__InfluenzaA__AFN19653

SEQ ID NO: 162066 - RNA, 1701 nt, Artificial Sequence; identical to SEQ ID NO: 161973
  derived and/or modified sequence opt4 from hemagglutinin__InfluenzaA__AFN19663

SEQ ID NO: 162067 - RNA, 1701 nt, Artificial Sequence; identical to SEQ ID NO: 161981
  derived and/or modified sequence opt4 from hemagglutinin__InfluenzaA__AFN19665

SEQ ID NO: 162068 - RNA, 1701 nt, Artificial Sequence
  derived and/or modified sequence opt4 from hemagglutinin__InfluenzaA__AFN19667
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaugagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162069 - RNA, 1701 nt, Artificial Sequence
  derived and/or modified sequence opt4 from hemagglutinin__InfluenzaA__AFN19669
augaagaccaucaucgcccugagcuacauccugugcaugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccaacuacgccagccugagaagccugguggccagcagcggcacccuggaguucaacaacgagagcuucaacuggaccggcgugacccagaacggcaccagcagcgccugcaugagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162070 - RNA, 1701 nt, Artificial Sequence
  derived and/or modified sequence opt4 from hemagglutinin__InfluenzaA__AFN19671
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162071 - RNA, 1701 nt, Artificial Sequence; identical to SEQ ID NO: 161594
  derived and/or modified sequence opt4 from hemagglutinin__InfluenzaA__AFN19674

SEQ ID NO: 162072 - RNA, 1701 nt, Artificial Sequence; identical to SEQ ID NO: 161594
  derived and/or modified sequence opt4 from hemagglutinin__InfluenzaA__AFN19676

SEQ ID NO: 162073 - RNA, 1701 nt, Artificial Sequence; identical to SEQ ID NO: 161981
  derived and/or modified sequence opt4 from hemagglutinin__InfluenzaA__AFN19678

SEQ ID NO: 162074 - RNA, 1701 nt, Artificial Sequence
  derived and/or modified sequence opt4 from hemagglutinin__InfluenzaA__AFN19682
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccaacuacgccagccugagaagccugguggccagcagcggcacccuggaguucaacaacgagagcuucaacuggaccggcgugacccagaacggcaccagcagcgccugcaugagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucaagugcaacaucugcaucuga

SEQ ID NO: 162075 - RNA, 1701 nt, Artificial Sequence
  derived and/or modified sequence opt4 from hemagglutinin__InfluenzaA__AFN19684
augaagaccaucaucgcccugagcuacauccugugccuggccuucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162076 - RNA, 1701 nt, Artificial Sequence
  derived and/or modified sequence opt4 from hemagglutinin__InfluenzaA__AFN19686
augaagaccaucaucgcccugagcuacauccugugccuggccuucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacauccccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162077 - RNA, 1701 nt, Artificial Sequence
  derived and/or modified sequence opt4 from hemagglutinin__InfluenzaA__AFN19688
augaagaccaucaucgcccugagcuacauccugugccugguguucgcccaggagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162078 - RNA, 1701 nt, Artificial Sequence
  derived and/or modified sequence opt4 from hemagglutinin__InfluenzaA__AFN19690
augaagaccaccaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggaccugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162079 - RNA, 1701 nt, Artificial Sequence
  derived and/or modified sequence opt4 from hemagglutinin__InfluenzaA__AFN19692
augaagaccaucaucgcccugagcuacauccugugccugguguucgcccagaagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcgacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162080 - RNA, 1701 nt, Artificial Sequence
  derived and/or modified sequence opt4 from hemagglutinin__InfluenzaA__AFN19694
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagccccaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162081 - RNA, 1701 nt, Artificial Sequence
  derived and/or modified sequence opt4 from hemagglutinin__InfluenzaA__AFN19700
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagauucaacuggagcggcgugacccagaacggcaccagcagcgccugcaugagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162082 - RNA, 1701 nt, Artificial Sequence
  derived and/or modified sequence opt4 from hemagglutinin__InfluenzaA__AFN19702
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaggcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162083 - RNA, 1701 nt, Artificial Sequence; identical to SEQ ID NO: 159335
  derived and/or modified sequence opt4 from hemagglutinin__InfluenzaA__AFN19709

SEQ ID NO: 162084 - RNA, 1701 nt, Artificial Sequence
  derived and/or modified sequence opt4 from hemagglutinin__InfluenzaA__AFN19719
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaacccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaguguaccagauccuggccaucuacagcaccguggccagcagccuggugcugguggugagccugggcgccaucagcuucuggaugugcagcaacggcagccugcagugcagaaucugcaucuga

SEQ ID NO: 162085 - RNA, 1701 nt, Artificial Sequence; identical to SEQ ID NO: 158955
  derived and/or modified sequence opt4 from hemagglutinin__InfluenzaA__AFN19730

SEQ ID NO: 162086 - RNA, 1701 nt, Artificial Sequence; identical to SEQ ID NO: 159335
  derived and/or modified sequence opt4 from hemagglutinin__InfluenzaA__AFN19736

SEQ ID NO: 162087 - RNA, 1701 nt, Artificial Sequence
  derived and/or modified sequence opt4 from hemagglutinin__InfluenzaA__AFN19748
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaccggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaccggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162088 - RNA, 1701 nt, Artificial Sequence; identical to SEQ ID NO: 159344
  derived and/or modified sequence opt4 from hemagglutinin__InfluenzaA__AFN19757

SEQ ID NO: 162089 - RNA, 1701 nt, Artificial Sequence; identical to SEQ ID NO: 159335
  derived and/or modified sequence opt4 from hemagglutinin__InfluenzaA__AFN19768

SEQ ID NO: 162090 - RNA, 1701 nt, Artificial Sequence
  derived and/or modified sequence opt4 from hemagglutinin__InfluenzaA__AFN19781
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccguggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162091 - RNA, 1701 nt, Artificial Sequence
  derived and/or modified sequence opt4 from hemagglutinin__InfluenzaA__AFN19791
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugaucgugagccugggcgccaucagcuucuggaugugcagcaacggcagccugcagugcagaaucugcaucuga

SEQ ID NO: 162092 - RNA, 1701 nt, Artificial Sequence; identical to SEQ ID NO: 159335
  derived and/or modified sequence opt4 from hemagglutinin__InfluenzaA__AFN19806

SEQ ID NO: 162093 - RNA, 1701 nt, Artificial Sequence
  derived and/or modified sequence opt4 from hemagglutinin__InfluenzaA__AFN19808
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccaacagcuggagcuacaucguggagaccagcagcagcgacaacggcaccugcuaccccggcgacuucaucgacuacgaggagcugagagagcagcugagcagcgugagcagcuucgagagauucgagaucuuccccaagaccaacagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgcccacgacugcaacaccaccugccagacccccaagggcgccaucaacaccagccugcccuuccagaacauccaccccaucaccaucggcaagugccccaaguacgugaacagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162094 - RNA, 1701 nt, Artificial Sequence; identical to SEQ ID NO: 159344
  derived and/or modified sequence opt4 from hemagglutinin__InfluenzaA__AFN19814

SEQ ID NO: 162095 - RNA, 1701 nt, Artificial Sequence
  derived and/or modified sequence opt4 from hemagglutinin__InfluenzaA__AFN19816
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162096 - RNA, 1701 nt, Artificial Sequence
  derived and/or modified sequence opt4 from hemagglutinin__InfluenzaA__AFN19821
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaagcugaagcccgagaucgccaucagacccaaggugagagaccaggagggcagaaugaacuacuacuggacccugguggagcccggcggcaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162097 - RNA, 1701 nt, Artificial Sequence; identical to SEQ ID NO: 158955
  derived and/or modified sequence opt4 from hemagglutinin__InfluenzaA__AFN19831

SEQ ID NO: 162098 - RNA, 1701 nt, Artificial Sequence
  derived and/or modified sequence opt4 from hemagglutinin__InfluenzaA__AFN19849
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcgacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccaggccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgcccagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcgacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162099 - RNA, 1701 nt, Artificial Sequence
  derived and/or modified sequence opt4 from hemagglutinin__InfluenzaA__AFN19865
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccuggugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162100 - RNA, 1701 nt, Artificial Sequence
  derived and/or modified sequence opt4 from hemagglutinin__InfluenzaA__AFN19875
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgagaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162101 - RNA, 1701 nt, Artificial Sequence
  derived and/or modified sequence opt4 from hemagglutinin__InfluenzaA__AFN19895
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagaucagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcagaugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaccggcaacggcugcuucgaguucuaccacaagugcgacaacaccugcauggagagcgugaagaacggcaccuacgacuaccccaaguacagcgaggaggccaagcugaacagagaggugaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162102 - RNA, 1701 nt, Artificial Sequence
  derived and/or modified sequence opt4 from hemagglutinin__InfluenzaA__AFN19905
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccguggacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugaucgugagccugggcgccaucagcuucuggaugugcagcaacggcagccugcagugcagaaucugcaucuga

SEQ ID NO: 162103 - RNA, 1701 nt, Artificial Sequence
  derived and/or modified sequence opt4 from hemagglutinin__InfluenzaA__AFN19915
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccaggccggcgccaagagcuucuacaagaaccugaucuggcuggugaagaagggcaacagcuaccccaagcugagcagcagcuacaucaacgacaagggcaaggaggugcuggugcuguggggcauccaccaccccagcaccagcgccgaccagcagagccuguaccagaacgccgacgccuacguguucgugggcaccagcgaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgcccagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162104 - RNA, 1701 nt, Artificial Sequence
  derived and/or modified sequence opt4 from hemagglutinin__InfluenzaA__AFN19922
augaaggccauccuggugguggugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcagaagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgcccaggacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162105 - RNA, 1701 nt, Artificial Sequence; identical to SEQ ID NO: 158974
  derived and/or modified sequence opt4 from hemagglutinin__InfluenzaA__AFN19931

SEQ ID NO: 162106 - RNA, 1701 nt, Artificial Sequence
  derived and/or modified sequence opt4 from hemagglutinin__InfluenzaA__AFN19941
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaucagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccaggccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgcccagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162107 - RNA, 1701 nt, Artificial Sequence
  derived and/or modified sequence opt4 from hemagglutinin__InfluenzaA__AFN19951
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaccggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 162108 - RNA, 1701 nt, Artificial Sequence; identical to SEQ ID NO: 159335
  derived and/or modified sequence opt4 from hemagglutinin__InfluenzaA__AFN19966

SEQ ID NO: 162109 - RNA, 1701 nt, Artificial Sequence
  derived and/or modified sequence opt4 from hemagglutinin__InfluenzaA__AFN19972
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacaacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaguguaccagauccuggccaucuacagcaccguggccagcagccuggugcugguggugagccugggcgccaucagcuucuggaugugcagcaacggcagccugcagugcagaaucugcaucuga

SEQ ID NO: 162110 - RNA, 1701 nt, Artificial Sequence
  derived and/or modified sequence opt4 from hemagglutinin__InfluenzaA__AFN19978
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162111 - RNA, 1701 nt, Artificial Sequence; identical to SEQ ID NO: 159335
  derived and/or modified sequence opt4 from hemagglutinin__InfluenzaA__AFN19983

SEQ ID NO: 162112 - RNA, 1701 nt, Artificial Sequence
  derived and/or modified sequence opt4 from hemagglutinin__InfluenzaA__AFN19993
augaaggccauccugguggugcugcuguacaccguggccaccaccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162113 - RNA, 1701 nt, Artificial Sequence; identical to SEQ ID NO: 159335
  derived and/or modified sequence opt4 from hemagglutinin__InfluenzaA__AFN20000

SEQ ID NO: 162114 - RNA, 1701 nt, Artificial Sequence; identical to SEQ ID NO: 159342
  derived and/or modified sequence opt4 from hemagglutinin__InfluenzaA__AFN20006

SEQ ID NO: 162115 - RNA, 1701 nt, Artificial Sequence; identical to SEQ ID NO: 158974
  derived and/or modified sequence opt4 from hemagglutinin__InfluenzaA__AFN20012

SEQ ID NO: 162116 - RNA, 1701 nt, Artificial Sequence
  derived and/or modified sequence opt4 from hemagglutinin__InfluenzaA__AFN20018
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccaggccggcgccaagagcuucuacaagaaccugaucuggcuggugaagaagggcaacagcuaccccaagcugagcaacagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgcccagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162117 - RNA, 1701 nt, Artificial Sequence; identical to SEQ ID NO: 159344
  derived and/or modified sequence opt4 from hemagglutinin__InfluenzaA__AFN20019

SEQ ID NO: 162118 - RNA, 1701 nt, Artificial Sequence; identical to SEQ ID NO: 158974
  derived and/or modified sequence opt4 from hemagglutinin__InfluenzaA__AFN20021

SEQ ID NO: 162119 - RNA, 1701 nt, Artificial Sequence; identical to SEQ ID NO: 159344
  derived and/or modified sequence opt4 from hemagglutinin__InfluenzaA__AFN20034

SEQ ID NO: 162120 - RNA, 1701 nt, Artificial Sequence; identical to SEQ ID NO: 159335
  derived and/or modified sequence opt4 from hemagglutinin__InfluenzaA__AFN20040

SEQ ID NO: 162121 - RNA, 1701 nt, Artificial Sequence; identical to SEQ ID NO: 162107
  derived and/or modified sequence opt4 from hemagglutinin__InfluenzaA__AFN20046

SEQ ID NO: 162122 - RNA, 1701 nt, Artificial Sequence; identical to SEQ ID NO: 159344
  derived and/or modified sequence opt4 from hemagglutinin__InfluenzaA__AFN20052

SEQ ID NO: 162123 - RNA, 1701 nt, Artificial Sequence; identical to SEQ ID NO: 159344
  derived and/or modified sequence opt4 from hemagglutinin__InfluenzaA__AFN20061

SEQ ID NO: 162124 - RNA, 1701 nt, Artificial Sequence
  derived and/or modified sequence opt4 from hemagglutinin__InfluenzaA__AFN20076
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgacugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaccggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162125 - RNA, 1701 nt, Artificial Sequence
  derived and/or modified sequence opt4 from hemagglutinin__InfluenzaA__AFN20081
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagaucagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccuggugauccccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcagaugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaccggcaacggcugcuucgaguucuaccacaagugcgacaacaccugcauggagagcgugaagaacggcaccuacgacuaccccaaguacagcgaggaggccaagcugaacagagaggugaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162126 - RNA, 1701 nt, Artificial Sequence; identical to SEQ ID NO: 159344
  derived and/or modified sequence opt4 from hemagglutinin__InfluenzaA__AFN20092

SEQ ID NO: 162127 - RNA, 1701 nt, Artificial Sequence; identical to SEQ ID NO: 162106
  derived and/or modified sequence opt4 from hemagglutinin__InfluenzaA__AFN20099

SEQ ID NO: 162128 - RNA, 1701 nt, Artificial Sequence
  derived and/or modified sequence opt4 from hemagglutinin__InfluenzaA__AFN20112
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcaagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacaaccccaacaagggcgugaccgccgccugcccccacgccggcgccaagagcuucuacaagaaccugaucuggcuggugaagaacggcaacagcuaccccaagcugaacaccagcuacaucaacgacaagggcaaggaggugcuggugcuguggggcauccaccaccccagcaccagcgccgaccagcagagccuguaccagaacgccgacgccuacgccuucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacaccagcgugcacgacugcaacaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccuucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaccaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162129 - RNA, 1701 nt, Artificial Sequence
  derived and/or modified sequence opt4 from hemagglutinin__InfluenzaA__AFN87924
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaccagcuacaucaacgacaagagaaaggaggugcuggugcuguggggcauccaccaccccagcaccagcgccgaccagcagagccuguaccagaacgccgacgccuacgccuucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacaccagcgugcacgacugcaacaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccuucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162130 - RNA, 1701 nt, Artificial Sequence; identical to SEQ ID NO: 155189
  derived and/or modified sequence opt4 from hemagglutinin__InfluenzaA__AFN87926

SEQ ID NO: 162131 - RNA, 1701 nt, Artificial Sequence
  derived and/or modified sequence opt4 from hemagglutinin__InfluenzaA__AFN87927
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagagaaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcggcacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacagagugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162132 - RNA, 1701 nt, Artificial Sequence
  derived and/or modified sequence opt4 from hemagglutinin__InfluenzaA__AFN87928
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcuggccgugagccugggcgccaucagcuucuggaugugcagcaacggcagccugcagugcagaaucugcaucuga

SEQ ID NO: 162133 - RNA, 1701 nt, Artificial Sequence; identical to SEQ ID NO: 156353
  derived and/or modified sequence opt4 from hemagglutinin__InfluenzaA__AFN87929

SEQ ID NO: 162134 - RNA, 1701 nt, Artificial Sequence; identical to SEQ ID NO: 156353
  derived and/or modified sequence opt4 from hemagglutinin__InfluenzaA__AFN87930

SEQ ID NO: 162135 - RNA, 1701 nt, Artificial Sequence
  derived and/or modified sequence opt4 from hemagglutinin__InfluenzaA__AFN87931
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggagaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagcaucuaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162136 - RNA, 1701 nt, Artificial Sequence
  derived and/or modified sequence opt4 from hemagglutinin__InfluenzaA__AFN87932
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162137 - RNA, 1701 nt, Artificial Sequence; identical to SEQ ID NO: 156353
  derived and/or modified sequence opt4 from hemagglutinin__InfluenzaA__AFN87933

SEQ ID NO: 162138 - RNA, 1701 nt, Artificial Sequence
  derived and/or modified sequence opt4 from hemagglutinin__InfluenzaA__AFN87934
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcagcugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162139 - RNA, 1701 nt, Artificial Sequence
  derived and/or modified sequence opt4 from hemagglutinin__InfluenzaA__AFN87936
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaucagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaccagcuacaucaacgacaagggcaaggaggugcuggugcuguggggcauccaccaccccagcaccagcgccgaccagcagagccuguaccagaacgccgacgccuacgccuucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacaccagcgugcacgacugcaacaccaccugccagacccccaagggcgccaucaacaccagccugcccuuccagaacgugcaccccaucaccaucggcaagugccccaaguacgugaagagcaccaagcugagacuggccaccggccugagaaucgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccuucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162140 - RNA, 1701 nt, Artificial Sequence
  derived and/or modified sequence opt4 from hemagglutinin__InfluenzaA__AFN87938
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagaccagcaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162141 - RNA, 1701 nt, Artificial Sequence
  derived and/or modified sequence opt4 from hemagglutinin__InfluenzaA__AFN87939
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaccagcuacaucaacgacaagggcaaggaggugcuggugcuguggggcauccaccaccccagcaccagcgccgaccagcagagccuguaccagaacgccgacgccuacgccuucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacaccagcgugcacgacugcaacaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162142 - RNA, 1701 nt, Artificial Sequence
  derived and/or modified sequence opt4 from hemagglutinin__InfluenzaA__AFN87941
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162143 - RNA, 1701 nt, Artificial Sequence
  derived and/or modified sequence opt4 from hemagglutinin__InfluenzaA__AFN87943
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaucagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaccagcuacaucaacgacaagggcaaggaggugcuggugcuguggggcauccaccaccccagcaccagcgccgaccagcagagccuguaccagaacgccgacgccuacgccuucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacaccagcgugcacgacugcaacaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162144 - RNA, 1701 nt, Artificial Sequence
  derived and/or modified sequence opt4 from hemagglutinin__InfluenzaA__AFN87945
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacgacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162145 - RNA, 1701 nt, Artificial Sequence
  derived and/or modified sequence opt4 from hemagglutinin__InfluenzaA__AFN87947
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaccagcuacaucaacgacaagggcaaggaggugcuggugcuguggggcauccaccaccccagcaccagcgccgaccagcagagccuguaccagaacgccgacgccuacgccuucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacaccagcgugcacgacugcaacaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccuucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162146 - RNA, 1701 nt, Artificial Sequence
  derived and/or modified sequence opt4 from hemagglutinin__InfluenzaA__AFN87949
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162147 - RNA, 1701 nt, Artificial Sequence; identical to SEQ ID NO: 159460
  derived and/or modified sequence opt4 from hemagglutinin__InfluenzaA__AFN87951

SEQ ID NO: 162148 - RNA, 1701 nt, Artificial Sequence
  derived and/or modified sequence opt4 from hemagglutinin__InfluenzaA__AFN87953
augaaggccauccugguggugcugcuguacaccuucgccaccgccaacgccgacacccugugcaucggcuaccacgccaacaacagcaccgacaccguggacaccgugcuggagaagaacgugaccgugacccacagcgccaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccugaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162149 - RNA, 1701 nt, Artificial Sequence
  derived and/or modified sequence opt4 from hemagglutinin__InfluenzaA__AFN87955
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162150 - RNA, 1701 nt, Artificial Sequence
  derived and/or modified sequence opt4 from hemagglutinin__InfluenzaA__AFN87957
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaucagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaccagcuacaucaacgacaagggcaaggaggugcuggugcuguggggcauccaccaccccagcaccagcgccgaccagcagagccuguaccagaacgccgacgccuacgccuucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacaccagcgugcacgacugcaacaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccuucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaagugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162151 - RNA, 1701 nt, Artificial Sequence
  derived and/or modified sequence opt4 from hemagglutinin__InfluenzaA__AFN87959
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162152 - RNA, 1701 nt, Artificial Sequence; identical to SEQ ID NO: 155674
  derived and/or modified sequence opt4 from hemagglutinin__InfluenzaA__AFN87961

SEQ ID NO: 162153 - RNA, 1698 nt, Artificial Sequence
  derived and/or modified sequence opt4 from hemagglutinin__InfluenzaA__AFO64802
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccgugaagaacggccuguaccccaaccugagcaagagcuacgugaacaacaagggcaaggaggugcuggugcuguggggcgugcaccaccccagcaacaucagagaccagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162154 - RNA, 1701 nt, Artificial Sequence
  derived and/or modified sequence opt4 from hemagglutinin__InfluenzaA__AFO64813
augaaggccaagcugcuggugcugcugugcgccuucaccgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaacugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaagggcagaagcagcuucuacagaaaccugcuguggcugaccgagaagaacggcagcuaccccaaccugagcaagagcuacgugaacaacaaggagaaggaggugcuggugcuguggggcgugcaccaccccagcaacaucagagaccagagagccaucuaccacaccgagaacgccuacgugagcguggugagcagccacuacaacagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162155 - RNA, 1701 nt, Artificial Sequence
  derived and/or modified sequence opt4 from hemagglutinin__InfluenzaA__AFO64824
augaaggccauccugcuggugcugcugugcgccuucaccgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaacugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaagggcagaagcagcuucuacagaaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacaacagaagauucacccccgagaucgccaagagacccaaggugagaggccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugaagauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162156 - RNA, 1701 nt, Artificial Sequence
  derived and/or modified sequence opt4 from hemagglutinin__InfluenzaA__AFO64835
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaacugcagcguggccggcuggauccugggcaaccccgagugcgagagccuguucagcaaggagagcuggagcuacaucgccgagacccccgaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacagaaaccugcuguggcugaccaagaagaacggccuguaccccaaccugagcaagagcuacgugaacaacaaggagaaggaggugcuggugcuguggggcgugcaccaccccagcaacaucggcgagcagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162157 - RNA, 1701 nt, Artificial Sequence
  derived and/or modified sequence opt4 from hemagglutinin__InfluenzaA__AFO64846
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaacugcagcguggccggcuggauccugggcaaccccgagugcgagagccuguucaccaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacagaaaccugcuguggcugaccgagaagaacggccuguaccccaaccugagcaagagcuacgugaacaacaaggagaaggaggugcuggugcuguggggcgugcaccaccccagcaacaugggcgaccagagagccaucuaccacaccgagaacgccuacgugagcguggugagcagccacuacagcagaagauucacccccgagaucgccaagagacccaaggugagaggccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162158 - RNA, 1701 nt, Artificial Sequence
  derived and/or modified sequence opt4 from hemagglutinin__InfluenzaA__AFO64857
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcguggccggcuggauccugggcaaccccgagugcgagagccuguucagcaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucgccaagagacccaaggugagaggccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaccgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacggcagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162159 - RNA, 1701 nt, Artificial Sequence
  derived and/or modified sequence opt4 from hemagglutinin__InfluenzaA__AFO64868
augaaggugaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcguggccggcuggauccugggcaaccccgagugcgagagccuguucagcaaggagagcuggagcuacaucgccgagacccccaaccccgagaacggcaccugcuaccccggcugcuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaacaaggagaaggaggugcuggugcuguggggcgugcaccaccccagcaacaucagagaccagagagccaucuaccacaccgagaacgccuacgugagcguggugagcagccacuacagcagaagauucacccccgagaucgccaagagacccaaggugagaggccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162160 - RNA, 1698 nt, Artificial Sequence
  derived and/or modified sequence opt4 from hemagglutinin__InfluenzaA__AFO64879
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucuucaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccgagaagaacggccuguaccccaaccugagcaagagcuacgugaacaacaaggagaaggaggugcuggugcuguggggcgugcaccaccccagcaacaucagagaccagagagccaucuaccacaccgagaacgccuacgugagcguggugagcagccacuacagcagaagauucacccccgagaucgccaagagacccaaggugagaggccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162161 - RNA, 1698 nt, Artificial Sequence
  derived and/or modified sequence opt4 from hemagglutinin__InfluenzaA__AFO64890
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccgagaagaacggccuguaccccaaccugagcaagagcuacgugaacaacaaggagaaggaggugcuggugcuguggggcgugcaccaccccagcaacaucagagaccagagagccaucuaccacaccgagaacgccuacgugagcguggugagcagccacuacagcagaagauucacccccgagaucgccaagagacccaaggugagaggccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgugaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162162 - RNA, 1701 nt, Artificial Sequence
  derived and/or modified sequence opt4 from hemagglutinin__InfluenzaA__AFO64901
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcaucgccggcuggauccugggcaaccccgagugcgagagccuguucagcaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaacaagaagaaggaggugcuggugcuguggggcgugcaccaccccagcaacaucggcgaccagagagccaucuaccacaccgagaacgccuacgugagcguggugagcagccacuacagcagaagauucacccccgagaucgccaagagacccaaggugagaaaccaggagggcagaaucaacuacuacuggacccugcuggagcccggcgacaccaucaucuucgaggccaacggcaaccugaucgcccccugguacgccuucgcccugagcagaggcuucgagagcggcaucaucaccagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcaucaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcaaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162163 - RNA, 1698 nt, Artificial Sequence
  derived and/or modified sequence opt4 from hemagglutinin__InfluenzaA__AFO65016
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccaagaagaacggccuguaccccaaccugagcaagagcuacgugaacaacaaggagaaggaggugcuggugcuguggggcgugcaccaccccagcaacaucggcgaccagagaaccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccaucaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaaccuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162164 - RNA, 1698 nt, Artificial Sequence; identical to SEQ ID NO: 154635
  derived and/or modified sequence opt4 from hemagglutinin__InfluenzaA__AFO65027

SEQ ID NO: 162165 - RNA, 1698 nt, Artificial Sequence
  derived and/or modified sequence opt4 from hemagglutinin__InfluenzaA__AFO65038
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcaaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162166 - RNA, 1698 nt, Artificial Sequence
  derived and/or modified sequence opt4 from hemagglutinin__InfluenzaA__AFO66136
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcaaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162167 - RNA, 1701 nt, Artificial Sequence
  derived and/or modified sequence opt4 from hemagglutinin__InfluenzaA__AFO66147
augaaggccaagcugcuggugcugcugugcgccuucaccaccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcaucgccggcuggauccugggcaaccccgagugcgagagccuguucagcaaggagagcuggagcuacaucgccgagacccccaaccccaagaacggcaccugcuaccccggcuacuucgccgacuacgaggagcugagagagcagcugagcagcgugagcagcuucgagagauucgagaucuuccccaaggacagcagcuggcccaaccacaccgugaccaagggcgugaccgccagcugcagccacaacggcaagagcagcuucuacaagaaccugcuguggcugaccggcaagaacggccuguaccccaaccugagcaagagcuacgugaacaagaagggcaaggaggugcuggugcuguggggcgugcaccaccccagcaacaugggcgaccagagagccaucuaccacaaggagaacgccuacgugagcgugcugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaucagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacgugcccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcaucaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcaaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162168 - RNA, 1698 nt, Artificial Sequence
  derived and/or modified sequence opt4 from hemagglutinin__InfluenzaA__AFO66158
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaagggcagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcaaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162169 - RNA, 1698 nt, Artificial Sequence
  derived and/or modified sequence opt4 from hemagglutinin__InfluenzaA__AFO66169
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagaccagcaaccccgagaacggcaccugcuaccccggcuacuucaccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccacggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162170 - RNA, 1698 nt, Artificial Sequence
  derived and/or modified sequence opt4 from hemagglutinin__InfluenzaA__AFO66180
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagaaaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162171 - RNA, 1698 nt, Artificial Sequence
  derived and/or modified sequence opt4 from hemagglutinin__InfluenzaA__AFO66191
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcaaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162172 - RNA, 1698 nt, Artificial Sequence; identical to SEQ ID NO: 153032
  derived and/or modified sequence opt4 from hemagglutinin__InfluenzaA__AFO66202

SEQ ID NO: 162173 - RNA, 1698 nt, Artificial Sequence
  derived and/or modified sequence opt4 from hemagglutinin__InfluenzaA__AFO66213
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaagaagaaggaggugcuggugcuguggggcgugcaccacccccccaacaucggcaaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162174 - RNA, 1698 nt, Artificial Sequence
  derived and/or modified sequence opt4 from hemagglutinin__InfluenzaA__AFO66224
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcaaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162175 - RNA, 1698 nt, Artificial Sequence
  derived and/or modified sequence opt4 from hemagglutinin__InfluenzaA__AFO66235
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgugcagagagcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162176 - RNA, 1698 nt, Artificial Sequence
  derived and/or modified sequence opt4 from hemagglutinin__InfluenzaA__AFO66246
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcaaccagagagcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccgagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162177 - RNA, 1701 nt, Artificial Sequence
  derived and/or modified sequence opt4 from hemagglutinin__InfluenzaA__AFP33324
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcaucgccggcuggauccugggcaaccccgagugcgagagccuguucagcaaggagagcuggagcuacaucgccgagacccccaaccccaagaacggcaccugcuaccccggcuacuucgccgacuacgaggagcugagagagcagcugagcagcgugagcagcuucgagagauucgagaucuuccccaaggacagcagcuggcccaaccacaccgugaccaagggcgugaccgccagcugcagccacaacggcaagagcagcuucuacaagaaccugcuguggcugaccggcaagaacggccuguaccccaaccugagcaagagcuacgugaacaagaagggcaaggaggugcuggugcuguggggcgugcaccaccccagcaacaugggcgaccagagagccaucuaccacaaggagaacgccuacgugagcgugcugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaucagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacgugcccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcaucaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagacccagcugaagaacaacgccaaggagaucggcaacggcugcuucgaguucuaccacaagugcaacaacgagugcauggagagcgugaagaacggcaccuacgacuaccccaaguacagcaaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162178 - RNA, 1698 nt, Artificial Sequence
  derived and/or modified sequence opt4 from hemagglutinin__InfluenzaA__AFP33325
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugauccccaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccagccacaccgugaccggcgugagcgccagcugcagccacaacggcaagagcagcuucuacagaaaccugcuguggcugaccggcaagaacggccuguaccccaaccugagcaagagcuacagcaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagaggccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162179 - RNA, 1701 nt, Artificial Sequence
  derived and/or modified sequence opt4 from hemagglutinin__InfluenzaA__AFQ32573
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacgugggcgacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162180 - RNA, 1701 nt, Artificial Sequence
  derived and/or modified sequence opt4 from hemagglutinin__InfluenzaA__AFQ37281
augaaggccauccugguggugcugcuguacaccuucgccaccaccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcaccgaccagcagagccuguaccagaacgccgacgccuacguguucgugggcaccagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgcccacgacugcaacaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacaagugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 162181 - RNA, 1707 nt, Artificial Sequence
  derived and/or modified sequence opt4 from hemagglutinin__InfluenzaA__AFQ55689
augaacacccagauccuggcccugaucgccugcaugcugaucggcgccaagggcgacaagaucugccugggccaccacgccguggccaacggcaccaaggugaacacccugaccgagagaggcaucgagguggugaacgccaccgagaccguggagaccgccaacaccaagaagaucugcacccagggcaagagacccaccgaccugggccagugcggccugcugggcacccugaucggccccccccagugcgaccaguuccuggaguucgacgccgaccugaucaucgagagaagagagggcaccgacgugugcuaccccggcaaguucaccaacgaggagagccugagacagauccugagaggcagcggcggcaucgacaaggagagcaugggcuucaccuacagcggcaucagaaccaacggcgccaccagcgccugcagaagaagcggcagcagcuucuacgccgagaugaaguggcugcugagcaacagcgacaacgccgccuucccccagaugaccaagagcuacagaaaccccagaaacaagcccgcccugaucaucuggggcgugcaccacagcggcagcgccaccgagcagaccaagcuguacggcagcggcaacaagcugaucaccgugggcagcagcaaguaccagcagagcuucacccccagccccggcgccagaccccaggugaacggccagagcggcagaaucgacuuccacuggcugcugcuggaccccaacgacaccgugaccuucaccuucaacggcgccuucaucgcccccgacagagccagcuucuucagaggcgagagcaucggcgugcagagcgacgugccccuggacagcggcugcgagggcgacugcuuccacaacggcggcaccaucgugagcagccugcccuuccagaacaucaaccccagaaccgugggcaagugccccagauacgugaagcagaccagccugcugcuggccaccggcaugagaaacgugcccgagaaccccaaggacagaaagagcagacacagaagaaccagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgacaagaccaaccagcaguucgagcugaucgacaacgaguucagcgagaucgagcagcagaucggcaacgugaucaacuggaccagagacagcaugaccgagguguggagcuacaacgccgagcugcugguggccauggagaaccagcacaccaucgaccuggccgacagcgagaugaacaagcuguacgagagagugagaaagcagcugagagagaacgccgaggaggacggcaccggcugcuucgagaucuuccacaagugcgacgaccagugcauggagagcaucagaaacaacaccuacgaccacacccaguacagagccgagagccugcagaacagaauccagaucgaccccgugaagcugagcagcggcuacaaggacaucauccugugguucagcuucggcgccagcugcuuccugcugcuggccaucgccaugggccugguguucaucugcaucaagaacggcaacaugagaugcaccaucugcaucuga

SEQ ID NO: 162182 - RNA, 1701 nt, Artificial Sequence; identical to SEQ ID NO: 160706
  derived and/or modified sequence opt4 from hemagglutinin__InfluenzaA__AFR68153

SEQ ID NO: 162183 - RNA, 1701 nt, Artificial Sequence
  derived and/or modified sequence opt4 from hemagglutinin__InfluenzaA__AFR68163
augaaggccacccugguggugcugcuguacaccuucgccaccgccaacgccgacacccugugcaucggcuaccacgccaacaacagcaccgacaccguggacaccgugcuggagaagaacgugaccgugacccacagcgccaaccugcuggaggacaagcacaacggcaagcugugcaagcugagaggcguggccccccugcaccugggcaagugcaacaucgccggcuggauccugggcaaccccgagugcgagacccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 162184 - RNA, 1701 nt, Artificial Sequence
  derived and/or modified sequence opt4 from hemagglutinin__InfluenzaA__AFR68173
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagagcgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162185 - RNA, 1701 nt, Artificial Sequence; identical to SEQ ID NO: 155189
  derived and/or modified sequence opt4 from hemagglutinin__InfluenzaA__AFR84675

SEQ ID NO: 162186 - RNA, 1701 nt, Artificial Sequence; identical to SEQ ID NO: 155542
  derived and/or modified sequence opt4 from hemagglutinin__InfluenzaA__AFR84685

SEQ ID NO: 162187 - RNA, 1701 nt, Artificial Sequence; identical to SEQ ID NO: 155369
  derived and/or modified sequence opt4 from hemagglutinin__InfluenzaA__AFR84694

SEQ ID NO: 162188 - RNA, 1701 nt, Artificial Sequence; identical to SEQ ID NO: 155176
  derived and/or modified sequence opt4 from hemagglutinin__InfluenzaA__AFR84704

SEQ ID NO: 162189 - RNA, 1701 nt, Artificial Sequence
  derived and/or modified sequence opt4 from hemagglutinin__InfluenzaA__AFR84714
augaaggccauccugguggugcugcuguacaccuucgccaccgccaacgccgacacccugugcaucggcuacagagccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162190 - RNA, 1701 nt, Artificial Sequence; identical to SEQ ID NO: 155369
  derived and/or modified sequence opt4 from hemagglutinin__InfluenzaA__AFR84724

SEQ ID NO: 162191 - RNA, 1701 nt, Artificial Sequence; identical to SEQ ID NO: 155369
  derived and/or modified sequence opt4 from hemagglutinin__InfluenzaA__AFR84734

SEQ ID NO: 162192 - RNA, 1701 nt, Artificial Sequence; identical to SEQ ID NO: 155369
  derived and/or modified sequence opt4 from hemagglutinin__InfluenzaA__AFR84754

SEQ ID NO: 162193 - RNA, 1701 nt, Artificial Sequence; identical to SEQ ID NO: 155369
  derived and/or modified sequence opt4 from hemagglutinin__InfluenzaA__AFR84764

SEQ ID NO: 162194 - RNA, 1701 nt, Artificial Sequence; identical to SEQ ID NO: 155369
  derived and/or modified sequence opt4 from hemagglutinin__InfluenzaA__AFR84774

SEQ ID NO: 162195 - RNA, 1701 nt, Artificial Sequence
  derived and/or modified sequence opt4 from hemagglutinin__InfluenzaA__AFR84784
augaaggccauccuggugggccugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggcccugguggugagccugggcgccaucagcuucuggaugugcagcaacggcagccugcagugcagaaucugcaucuga

SEQ ID NO: 162196 - RNA, 1701 nt, Artificial Sequence; identical to SEQ ID NO: 155369
  derived and/or modified sequence opt4 from hemagglutinin__InfluenzaA__AFR84794

SEQ ID NO: 162197 - RNA, 1701 nt, Artificial Sequence; identical to SEQ ID NO: 155189
  derived and/or modified sequence opt4 from hemagglutinin__InfluenzaA__AFR84804

SEQ ID NO: 162198 - RNA, 1701 nt, Artificial Sequence; identical to SEQ ID NO: 155369
  derived and/or modified sequence opt4 from hemagglutinin__InfluenzaA__AFR84814

SEQ ID NO: 162199 - RNA, 1701 nt, Artificial Sequence; identical to SEQ ID NO: 155189
  derived and/or modified sequence opt4 from hemagglutinin__InfluenzaA__AFR84824

SEQ ID NO: 162200 - RNA, 1701 nt, Artificial Sequence; identical to SEQ ID NO: 155215
  derived and/or modified sequence opt4 from hemagglutinin__InfluenzaA__AFR84834

SEQ ID NO: 162201 - RNA, 1701 nt, Artificial Sequence; identical to SEQ ID NO: 160389
  derived and/or modified sequence opt4 from hemagglutinin__InfluenzaA__AFR84844

SEQ ID NO: 162202 - RNA, 1701 nt, Artificial Sequence; identical to SEQ ID NO: 155431
  derived and/or modified sequence opt4 from hemagglutinin__InfluenzaA__AFR84854

SEQ ID NO: 162203 - RNA, 1701 nt, Artificial Sequence; identical to SEQ ID NO: 155189
  derived and/or modified sequence opt4 from hemagglutinin__InfluenzaA__AFR84864

SEQ ID NO: 162204 - RNA, 1701 nt, Artificial Sequence; identical to SEQ ID NO: 155369
  derived and/or modified sequence opt4 from hemagglutinin__InfluenzaA__AFR84874

SEQ ID NO: 162205 - RNA, 1701 nt, Artificial Sequence; identical to SEQ ID NO: 155176
  derived and/or modified sequence opt4 from hemagglutinin__InfluenzaA__AFR84893

SEQ ID NO: 162206 - RNA, 1701 nt, Artificial Sequence; identical to SEQ ID NO: 155176
  derived and/or modified sequence opt4 from hemagglutinin__InfluenzaA__AFR84903

SEQ ID NO: 162207 - RNA, 1701 nt, Artificial Sequence; identical to SEQ ID NO: 155176
  derived and/or modified sequence opt4 from hemagglutinin__InfluenzaA__AFR84913

SEQ ID NO: 162208 - RNA, 1701 nt, Artificial Sequence; identical to SEQ ID NO: 155176
  derived and/or modified sequence opt4 from hemagglutinin__InfluenzaA__AFR84923

SEQ ID NO: 162209 - RNA, 1689 nt, Artificial Sequence
  derived and/or modified sequence opt4 from hemagglutinin__InfluenzaA__AFV53205
auggccaucaucuaccugauccugcuguucgccaccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccagauacagccugugcuaccccggcagccugaacgacuacgaggagcugaagcaccugcugagcagcgugagacacuucgagaaggugagaauccugcccaaggacagauggacccagcacaccaccaccggcgacagcaaggccugcgccgugagcggcaagcccagcuucuucagaaacaugguguggcugaccaagaagggccccgacuaccccguggccaagggcagcuacaacaacaccagcggcgagcagaugcugaucaucuggggcgugcaccaccccaucgacgaggccgagcagagagagcuguaccagaaggugggcaccuacgugagcgccagcaccagcacccugaacaagagaagcauccccgagaucgccgccagacccgaggugaacggccugagaagcagaauggaguucagcuggacccugcuggacgugugggacaccaucaacuucgagagcaccggcaaccugaucgcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacgagaucaccaacaaggugaacagcgugaucgagaagaugaacacccaguucgaggccgugggcaaggaguucaacaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacgagaaggugagaaugcagcugagagacaacgugaaggagcugggcaacggcugcuucgaguucuaccacaagugcgacgacgagugcaucaacagcgugaagaacggcaccuacgacuaccccaaguacgaggaggagagcaagcugaagagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 162210 - RNA, 1689 nt, Artificial Sequence
  derived and/or modified sequence opt4 from hemagglutinin__InfluenzaA__AFV53216
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugguguggcugaccgagaagggcagcaacuaccccguggccaagggcagcuacaacaacaccagcggcgagcagaugcugaucaucuggggcgugcaccaccccaacgacgagaccgagcagagaacccuguaccagaacgugggcaccuacgugagcgugggcaccagcacccugaacaagagaagcacccccgacaucgccaccagacccaaggugaacggccagggcggcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccguggagaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcaucuaccagauccuggccaucuacgccaccguggccggcagccugagccuggccaucaugauggccggcaucagcuucuggaugugcagcaacggcagccugcagugcagaaucugcaucuga

SEQ ID NO: 162211 - RNA, 1689 nt, Artificial Sequence
  derived and/or modified sequence opt4 from hemagglutinin__InfluenzaA__AFV53227
augaucaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccagauacagccugugcuaccccggcagcuucaacgacuacgaggagcugaagcaccugcugagcagcgugaagcacuucgagaaggugaagauccugcccaaggacggcuggacccagcacaagaccgacggcggcagcaaggccugcgccgugagcggcaaggccagcuucuucagaaacaugguguggcugaccaaggagggccccaacuaccagguggccaagagaagcuacaacaacaccagcggcgagcagaugcugaucaucuggggcgugcaccaccccaaggacgaggccgagcagaucgcccuguaccagaaggugggcaccuacgugagcgccagcaccagcacccugaacaagagaagcacccccgagaucgccgccagacccgaggugaacggccugggcagcagaauggaguucagcuggacccugcuggacgugugggacaccaucaacuucgagagcaccggcaaccugguggcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacagaaucaccaacaaggugaacagcgugaucgagaagaugaacauccaguucgaggccgugggcaaggaguucagcaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaagagaaacgagaucaagggcgugaagcugagcagcaugggcguguaccagauccuggccaucuacgccaccguggccggcagccugagccuggccaucaugaucgccggcaucagcuucuggaugugcagcaacggcagccugcagugcagagugugcaucuga

SEQ ID NO: 162212 - RNA, 1689 nt, Artificial Sequence
  derived and/or modified sequence opt4 from hemagglutinin__InfluenzaA__AFV53238
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccagauacagccugugcuaccccggcagcuucaacgacuacgaggagcugaagcaccugcugagcagcgugaagcacuucgagaaggugaagauccugcccaaggacagauggacccagcacaccaccaccggcggcagcauggccugcgccgugagcggcaagcccagcuucuucagaaacaugguguggcugaccaccaagggccccaacuaccccguggcccagggcagcuacaacaacaccagcggcgagcagaugcugaucaucuggggcgugcaccaccccaacgacgaggccgagcagagagcccuguaccagaaggugggcaccuacgugagcgccagcaccagcacccuguacaagagaagcauccccgagaucgccgccagacccaaggugaacggccugggcagcagaauggaguucagcuggacccugcuggacaugugggacaccaucaacuucgagagcaccggcaaccugguggcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacaacgagugcauggacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 162213 - RNA, 1689 nt, Artificial Sequence
  derived and/or modified sequence opt4 from hemagglutinin__InfluenzaA__AFV53249
auggccaucaucuaccugauccugcuguucgccaccgugagaggcgaccagaucugcaucggcuaccacgccaacaacagcaccgagaccguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccagauacagccugugcuaccccggcagccugaacgacuacgaggagcugaagcaccugcugagcagcgugaagcacuucgagaaggugagaauccugcccaaggacagauggaccaaccacaccaccaccggcggcagcaaggccugcgccgugagcggcgagcccagcuucuucagaaacaugguguggcugaccaagaagggccccaacuaccccguggccaagggcagcuacaacaacaccagcggcgagcagaugcugaucaucuggggcgugcaccaccccaacgacgaggccgagcagagagcccuguaccagaaggugggcaccuacgugagcgccagcaccagcacccuguacaagagaagcauccccgagaucgccgccagacccaaggugaacggccugggcagcagaauggaguucagcuggacccugcugaacgugugggacaccaucaacuucgagagcaccggcaaccugguggcccccgaguacggcuucaagaucagcaagagaggcagaagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucaacaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacgagaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaagagaaacgagaucaagggcgugaagcugagcagcaugggcguguaccagauccuggccaucuacgccaccguggccggcagccugagccuggccaucaugguggccggcaucagcuucuggaugugcagcaacggcagccugcagugcagaaucugcaucuga

SEQ ID NO: 162214 - RNA, 1698 nt, Artificial Sequence
  derived and/or modified sequence opt4 from hemagglutinin__InfluenzaA__AFV53260
augaaggccaagcugcugauccugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaaggccccccugcagcugggcaacugcaacaucgccggcugggugcugggcaaccccgagugcgagagccugcugagcaacagaagcuggagcuacaucgccgagacccccaacagcgagaacggcaccugcuaccccggcgacuucgccgacuacgaggagcugagagagcagcugagcagcgugagcagcuucgagagauucgagaucuuccccaaggagagaagcuggcccaaccacaccaccagaggcgugaccgccgccugcccccacgccaugaagagcagcuucuacaagaaccugguguggcugaccgaggccaacggcagcuaccccaaccugagcagaagcuacgugaacaaccaggagaaggaggugcuggugcuguggggcgugcaccaccccagcaacaucgaggaccagagaacccuguacagaaaggacaacgccuacgugagcguggugagcagcaacuacaacagaagauucacccccgagaucgccaagagacccaaggugagaggccagagcggcagaaucaacuacuacuggacccugcuggagcccggcgacaccaucaucuucgaggccaccggcaaccugaucgcccccugguacgccuucgcccugagcagaggccccggcagcggcaucaucaccagcaacgccccccuggacgagugcgacaccaagugccagaccccccagggcgccaucaacagcagccugcccuuccagaacauccaccccgugaccaucggcgagugccccaaguacgugagaagcaccaagcugagaauggugaccggccugagaaacauccccagcuuccagagcagaggccuguucggcgccaucgccggcuucaucgagggcggcuggaccggcaugauggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugagaaacaacgccaaggagcugggcaacggcugcuucgaguucuaccacaagugcgacaacgagugcauggagagcgugaagaacggcaccuacgacuaccccaaguacagcgaggagagcaagcugaacagagagaagaucgacggcgugaagcuggagagcaugggcguguacagaauccuggccaucuacagcaccguggccagcagccuggugcugcuggugagccugggcgccaucagcuucuggaugugcagcaacggcagccugcagugcagaaucugcaucuga

SEQ ID NO: 162215 - RNA, 1689 nt, Artificial Sequence
  derived and/or modified sequence opt4 from hemagglutinin__InfluenzaA__AFV53271
auggccaucaccuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagauuccugagagugcccgaguggagcuacaucauggagaaggagaaccccagauacagccugugcuaccccggcagcuucaacgacuacgaggagcugaagcaccugcugagcagcgugaagcacuucgagaaggugaagauccugcccaaggacggcuggacccagcacaccaccaccggcggcagcauggccugcgccgugagcggcaagcccagcuucuucagaaacaugguguggcugaccgagaagggccagaacuaccccguggccaagggcagcuacaacaacaccagcggcgagcagaugcugaucaucuggggcgugcaccaccccaacgacgaggccgagcagagagcccuguaccagaaggugggcaccuacgugagcgccagcaccagcacccugaacaagagaagcacccccgagaucgccgccagacccaaggugaacggccugggcagcagaauggaguucagcuggacccugcuggacaugugggacaccaucaacuucgagagcaccggcaaccugguggcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacaucccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacaacgagugcauggacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 162216 - RNA, 1689 nt, Artificial Sequence
  derived and/or modified sequence opt4 from hemagglutinin__InfluenzaA__AFV53282
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugguguggcugaccaagaagggcaccaacuaccccguggccaagggcagcuacaacaacaccagcggcgagcagaugcugaucaucuggggcgugcaccaccccaacgacgagaccgagcagagaacccuguaccagaacgugggcaccuacgugagcgugggcaccagcacccugaacaagagaagcacccccgagaucgccaccagacccaaggugaacggccugggcagcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccaaguacgugaagcuggagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacgugaucaccaacaaggugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 162217 - RNA, 1689 nt, Artificial Sequence
  derived and/or modified sequence opt4 from hemagglutinin__InfluenzaA__AFV53293
auggccaucaucuaccugauccugcuguucaccagcgugagaggcgaccagaucugcaucggcuaccacgccaacaacagcaccgagaagguggacaccauccuggagagaaacgugaccgugacccacgccaagaacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccaaguacagccugugcuaccccggcagcuucaacgacuacgaggagcugaagcaccugcugagcagcgugaagcacuucgagaaggugaagauccugcccaaggacggcuggacccagcacaccaccaacggcggcagcagagccugcgccgugagcggcaaccccagcuucuucagaaacaugguguggcugaccaagaagggccccaacuaccccguggccaagggcagcuacaacaacaccagcggcgagcagaugcugaucaucuggggcgugcaccaccccaacgacgaggccgagcagagagcccuguaccaggaggugggcaccuacgugagcgccagcaccagcacccugaacaagagaagcacccccgagaucgccgccagacccaaggugaacggccugggcagcagaauggaguucagcuggacccugcuggacaugugggacaccaucaacuucgagagcaccggcaaccugguggcccccgaguacggcuucaagaucagcaagagaggcagcagcggcgugaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcauggacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 162218 - RNA, 1689 nt, Artificial Sequence
  derived and/or modified sequence opt4 from hemagglutinin__InfluenzaA__AFV53304
auggccaucaucuaccugauccugcuguucaccgccgugagaggcgaccagaucugcaucggcuaccacgccaacaacagcaccgagaagguggacaccauccuggagcagaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugguguggcugaccaagaaggagagcaacuaccccguggccaagggcagcuacaacaacaccagcggcgagcagaugcugaucaucuggggcgugcaccaccccaacgacgagaccgagcagagaacccuguaccagaacgugggcaccuacgugagcgugggcaccagcacccugaacaagagaagcacccccaacaucgccaccagacccaaggugaacggccugggcagcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 162219 - RNA, 1689 nt, Artificial Sequence
  derived and/or modified sequence opt4 from hemagglutinin__InfluenzaA__AFV53314
auggccaucaucuaccugauccugcuguucaccgccgugagaggcgacaagaucugcaucggcuaccacgccaacaacagcaccgagaccguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagaaacggccugugcuaccccggcaacuucaacgacuacgaggagcugaagcaccugcugagcagcgugaagcacuucgagaaggugaagauccugcccaaggacagauggacccagcacaccaccaccggcggcagccaggccugcgccgugagcggcaaccccagcuucuucagaaacaugguguggcugaccgagaaggagagcaacuaccccguggccaagggcagcuacaacaacaccagcggcgagcagaugcugaucaucuggggcgugcaccaccccaucgacgagaccgagcagagaacccuguaccagaacgugggcaccuacgugagcgugggcaccagcacccugaacaagagaagcacccccgagaucgccaagagacccaaggugaacggccugggcagcagaauggaguucagcuggacccugcuggacaugugggacaccaucaccuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacgccgugaucgagaagaucaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 162220 - RNA, 1689 nt, Artificial Sequence
  derived and/or modified sequence opt4 from hemagglutinin__InfluenzaA__AFV53325
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugguguggcugaccaagaagggcagcaacuacaccguggccaagggcagcuacaacaacaccagcggcgagcagaugcugaucaucuggggcgugcaccaccccaacgacgagaccgagcagagaacccuguaccagaacgugggcaccuacgugagcgugagcaccagcacccugaacaagagaagcacccccgagaucgccaccagacccaaggugaacggccugggcagcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 162221 - RNA, 1689 nt, Artificial Sequence
  derived and/or modified sequence opt4 from hemagglutinin__InfluenzaA__AFV53336
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccagauacagccugugcuaccccggcagcuucaacgacuacgaggagcugaagcaccugcugagcagcgugaagcaccuggagaaggugaagauccugcccaaggacggcuggacccagcacgagaccgacggcggcagcaaggccugcgccgugagcggcaagcccagcuucuucagaaacaugguguggcugaccaagaagggccccaacuaccccguggccaagagaagcuacaacaacaccagcggcgagcagaugcugaucaucuggggcgugcaccaccccaacgacgaggccgagcagagagcccuguaccagaaggugggcaccuacgugagcgccagcaccagcacccugaacaagagaagcacccccgagaucgccgccagacccgaggugagcggccugggcagcagaauggaguucagcuggacccugcuggacgugugggacaccaucagcuucgagagcaccggcaaccugguggcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacagaaucaccaacaaggugaacagcgugaucgagaagaugaacacccaguucgaggccgugggcaaggaguucagcaaccuggagaagagacuggagaaccugaacaagaagauggaggacggcuuccuggacguguggaccuacaacgccgagcugcuggugcugauggagaacgagagaauccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaagagaaacgagaucaagggcgugaagcugagcagcaugggcguguaccagauccuggccaucuacgccaccguggccggcagccugagccuggccaucaugaucgccggcaucagcuucuggaugugcagcaacggcagccugcagugcagaaucugcaucuga

SEQ ID NO: 162222 - RNA, 1701 nt, Artificial Sequence
  derived and/or modified sequence opt4 from hemagglutinin__InfluenzaA__AFV68720
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcgacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162223 - RNA, 1701 nt, Artificial Sequence; identical to SEQ ID NO: 155189
  derived and/or modified sequence opt4 from hemagglutinin__InfluenzaA__AFX96347

SEQ ID NO: 162224 - RNA, 1701 nt, Artificial Sequence
  derived and/or modified sequence opt4 from hemagglutinin__InfluenzaA__AFX96359
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucaacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162225 - RNA, 1701 nt, Artificial Sequence
  derived and/or modified sequence opt4 from hemagglutinin__InfluenzaA__AFX96366
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacagaggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccagcuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162226 - RNA, 1701 nt, Artificial Sequence; identical to SEQ ID NO: 156689
  derived and/or modified sequence opt4 from hemagglutinin__InfluenzaA__AFX96383

SEQ ID NO: 162227 - RNA, 1701 nt, Artificial Sequence; identical to SEQ ID NO: 155189
  derived and/or modified sequence opt4 from hemagglutinin__InfluenzaA__AFX96398

SEQ ID NO: 162228 - RNA, 1701 nt, Artificial Sequence; identical to SEQ ID NO: 155189
  derived and/or modified sequence opt4 from hemagglutinin__InfluenzaA__AFX96408

SEQ ID NO: 162229 - RNA, 1701 nt, Artificial Sequence; identical to SEQ ID NO: 155189
  derived and/or modified sequence opt4 from hemagglutinin__InfluenzaA__AFX96418

SEQ ID NO: 162230 - RNA, 1701 nt, Artificial Sequence; identical to SEQ ID NO: 155189
  derived and/or modified sequence opt4 from hemagglutinin__InfluenzaA__AFX96428

SEQ ID NO: 162231 - RNA, 1701 nt, Artificial Sequence; identical to SEQ ID NO: 155189
  derived and/or modified sequence opt4 from hemagglutinin__InfluenzaA__AFX96438

SEQ ID NO: 162232 - RNA, 1701 nt, Artificial Sequence; identical to SEQ ID NO: 155189
  derived and/or modified sequence opt4 from hemagglutinin__InfluenzaA__AFX96448

SEQ ID NO: 162233 - RNA, 1701 nt, Artificial Sequence; identical to SEQ ID NO: 155189
  derived and/or modified sequence opt4 from hemagglutinin__InfluenzaA__AFX96458

SEQ ID NO: 162234 - RNA, 1701 nt, Artificial Sequence; identical to SEQ ID NO: 155189
  derived and/or modified sequence opt4 from hemagglutinin__InfluenzaA__AFX96468

SEQ ID NO: 162235 - RNA, 1701 nt, Artificial Sequence; identical to SEQ ID NO: 155189
  derived and/or modified sequence opt4 from hemagglutinin__InfluenzaA__AFX96478

SEQ ID NO: 162236 - RNA, 1701 nt, Artificial Sequence; identical to SEQ ID NO: 155189
  derived and/or modified sequence opt4 from hemagglutinin__InfluenzaA__AFX96488

SEQ ID NO: 162237 - RNA, 1701 nt, Artificial Sequence
  derived and/or modified sequence opt4 from hemagglutinin__InfluenzaA__AFX96498
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagaucagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162238 - RNA, 1701 nt, Artificial Sequence; identical to SEQ ID NO: 155189
  derived and/or modified sequence opt4 from hemagglutinin__InfluenzaA__AFX96508

SEQ ID NO: 162239 - RNA, 1701 nt, Artificial Sequence; identical to SEQ ID NO: 156689
  derived and/or modified sequence opt4 from hemagglutinin__InfluenzaA__AFX96518

SEQ ID NO: 162240 - RNA, 1701 nt, Artificial Sequence; identical to SEQ ID NO: 155189
  derived and/or modified sequence opt4 from hemagglutinin__InfluenzaA__AFX96528

SEQ ID NO: 162241 - RNA, 1701 nt, Artificial Sequence; identical to SEQ ID NO: 156689
  derived and/or modified sequence opt4 from hemagglutinin__InfluenzaA__AFX96538

SEQ ID NO: 162242 - RNA, 1701 nt, Artificial Sequence
  derived and/or modified sequence opt4 from hemagglutinin__InfluenzaA__AFX96548
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162243 - RNA, 1701 nt, Artificial Sequence; identical to SEQ ID NO: 155189
  derived and/or modified sequence opt4 from hemagglutinin__InfluenzaA__AFX96558

SEQ ID NO: 162244 - RNA, 1701 nt, Artificial Sequence; identical to SEQ ID NO: 156349
  derived and/or modified sequence opt4 from hemagglutinin__InfluenzaA__AFX96568

SEQ ID NO: 162245 - RNA, 1701 nt, Artificial Sequence; identical to SEQ ID NO: 156349
  derived and/or modified sequence opt4 from hemagglutinin__InfluenzaA__AFX96578

SEQ ID NO: 162246 - RNA, 1701 nt, Artificial Sequence; identical to SEQ ID NO: 155189
  derived and/or modified sequence opt4 from hemagglutinin__InfluenzaA__AFX96588

SEQ ID NO: 162247 - RNA, 1701 nt, Artificial Sequence; identical to SEQ ID NO: 155189
  derived and/or modified sequence opt4 from hemagglutinin__InfluenzaA__AFX96598

SEQ ID NO: 162248 - RNA, 1701 nt, Artificial Sequence
  derived and/or modified sequence opt4 from hemagglutinin__InfluenzaA__AFX96608
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcacccuggccagcagccuggugcugguggugagccugggcgccaucagcuucuggaugugcagcaacggcagccugcagugcagaaucugcaucuga

SEQ ID NO: 162249 - RNA, 1701 nt, Artificial Sequence; identical to SEQ ID NO: 155189
  derived and/or modified sequence opt4 from hemagglutinin__InfluenzaA__AFX96618

SEQ ID NO: 162250 - RNA, 1701 nt, Artificial Sequence; identical to SEQ ID NO: 156349
  derived and/or modified sequence opt4 from hemagglutinin__InfluenzaA__AFX96628

SEQ ID NO: 162251 - RNA, 1701 nt, Artificial Sequence
  derived and/or modified sequence opt4 from hemagglutinin__InfluenzaA__AFX96638
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugguguggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugauggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162252 - RNA, 1701 nt, Artificial Sequence; identical to SEQ ID NO: 155189
  derived and/or modified sequence opt4 from hemagglutinin__InfluenzaA__AFX96648

SEQ ID NO: 162253 - RNA, 1701 nt, Artificial Sequence; identical to SEQ ID NO: 156349
  derived and/or modified sequence opt4 from hemagglutinin__InfluenzaA__AFX96658

SEQ ID NO: 162254 - RNA, 1701 nt, Artificial Sequence
  derived and/or modified sequence opt4 from hemagglutinin__InfluenzaA__AFX96668
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugcagcaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162255 - RNA, 1701 nt, Artificial Sequence
  derived and/or modified sequence opt4 from hemagglutinin__InfluenzaA__AFX96678
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcagccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162256 - RNA, 1701 nt, Artificial Sequence
  derived and/or modified sequence opt4 from hemagglutinin__InfluenzaA__AFX96688
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgacugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgacggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162257 - RNA, 1701 nt, Artificial Sequence; identical to SEQ ID NO: 155189
  derived and/or modified sequence opt4 from hemagglutinin__InfluenzaA__AFX96698

SEQ ID NO: 162258 - RNA, 1701 nt, Artificial Sequence
  derived and/or modified sequence opt4 from hemagglutinin__InfluenzaA__AFX96718
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagaucagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaaggccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162259 - RNA, 1701 nt, Artificial Sequence; identical to SEQ ID NO: 162258
  derived and/or modified sequence opt4 from hemagglutinin__InfluenzaA__AFX96728

SEQ ID NO: 162260 - RNA, 1701 nt, Artificial Sequence; identical to SEQ ID NO: 155659
  derived and/or modified sequence opt4 from hemagglutinin__InfluenzaA__AFX96738

SEQ ID NO: 162261 - RNA, 1701 nt, Artificial Sequence
  derived and/or modified sequence opt4 from hemagglutinin__InfluenzaA__AFX96748
augaaggccauccugguggugcugcuguacaccaucgccaccgccaacgccgacacccugugcaucggcuaccacgccaacaacagcaccgacaccguggacaccgugaucgagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162262 - RNA, 1701 nt, Artificial Sequence
  derived and/or modified sequence opt4 from hemagglutinin__InfluenzaA__AFX96758
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162263 - RNA, 1701 nt, Artificial Sequence
  derived and/or modified sequence opt4 from hemagglutinin__InfluenzaA__AFX96768
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccaucagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccaagaucuaccagauccuggccaucuacagcaccguggccagcagccuggugcugguggugagccugggcgccaucagcuucuggaugugcagcaacggcagccugcagugcagaaucugcaucuga

SEQ ID NO: 162264 - RNA, 1701 nt, Artificial Sequence
  derived and/or modified sequence opt4 from hemagglutinin__InfluenzaA__AFX96778
augaaggccauccuggugauccugcuguacaccuucgccaccgccaacgccgacacccugugcaucggcuaccacgccaacaacagcaccgacaccguggacaccauccuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162265 - RNA, 1701 nt, Artificial Sequence
  derived and/or modified sequence opt4 from hemagglutinin__InfluenzaA__AFX96788
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagaagaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162266 - RNA, 1701 nt, Artificial Sequence; identical to SEQ ID NO: 162265
  derived and/or modified sequence opt4 from hemagglutinin__InfluenzaA__AFX96798

SEQ ID NO: 162267 - RNA, 1701 nt, Artificial Sequence; identical to SEQ ID NO: 156349
  derived and/or modified sequence opt4 from hemagglutinin__InfluenzaA__AFX96808

SEQ ID NO: 162268 - RNA, 1701 nt, Artificial Sequence; identical to SEQ ID NO: 159429
  derived and/or modified sequence opt4 from hemagglutinin__InfluenzaA__AFX96818

SEQ ID NO: 162269 - RNA, 1701 nt, Artificial Sequence; identical to SEQ ID NO: 162265
  derived and/or modified sequence opt4 from hemagglutinin__InfluenzaA__AFX96828

SEQ ID NO: 162270 - RNA, 1701 nt, Artificial Sequence; identical to SEQ ID NO: 157786
  derived and/or modified sequence opt4 from hemagglutinin__InfluenzaA__AFX96838

SEQ ID NO: 162271 - RNA, 1701 nt, Artificial Sequence
  derived and/or modified sequence opt4 from hemagglutinin__InfluenzaA__AFX96856
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcacccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162272 - RNA, 1701 nt, Artificial Sequence; identical to SEQ ID NO: 162254
  derived and/or modified sequence opt4 from hemagglutinin__InfluenzaA__AFX96904

SEQ ID NO: 162273 - RNA, 1701 nt, Artificial Sequence; identical to SEQ ID NO: 156689
  derived and/or modified sequence opt4 from hemagglutinin__InfluenzaA__AFX96914

SEQ ID NO: 162274 - RNA, 1701 nt, Artificial Sequence
  derived and/or modified sequence opt4 from hemagglutinin__InfluenzaA__AFX96924
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagagauucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162275 - RNA, 1701 nt, Artificial Sequence; identical to SEQ ID NO: 155189
  derived and/or modified sequence opt4 from hemagglutinin__InfluenzaA__AFX96934

SEQ ID NO: 162276 - RNA, 1701 nt, Artificial Sequence
  derived and/or modified sequence opt4 from hemagglutinin__InfluenzaA__AFY24097
augaaggccauccugguggugcugcuguacaccuucgccaccgccaacgccgacacccugugcaucggcuaccacgccgacaacagcaccgacaccguggacaccgugcuggagaagaacgugaccgugacccacagcguggaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaacaagagcuacaucaacgacaagggcaaggaggugcuggugcuguggggcauccaccaccccagcaccagcaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162277 - RNA, 1701 nt, Artificial Sequence; identical to SEQ ID NO: 153150
  derived and/or modified sequence opt4 from hemagglutinin__InfluenzaA__AFY24162

SEQ ID NO: 162278 - RNA, 1701 nt, Artificial Sequence
  derived and/or modified sequence opt4 from hemagglutinin__InfluenzaA__AFY24195
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162279 - RNA, 1701 nt, Artificial Sequence; identical to SEQ ID NO: 152705
  derived and/or modified sequence opt4 from hemagglutinin__InfluenzaA__AFY24217

SEQ ID NO: 162280 - RNA, 1701 nt, Artificial Sequence
  derived and/or modified sequence opt4 from hemagglutinin__InfluenzaA__AGB08294
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccaggccggcgccaagagcuucuacaagaaccugaucuggcuggugaagaagggcaacagcuaccccaagcugaucaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgugauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgcccagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccagauacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162281 - RNA, 1701 nt, Artificial Sequence
  derived and/or modified sequence opt4 from hemagglutinin__InfluenzaA__AGB08295
augaaggccauccugguggugcugcuguacaccuucgccaccgccaacgccgacacccugugcaucggcuaccacgccaacaacagcaccgacaccguggacaccgugaucgagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagagaaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaccgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162282 - RNA, 1701 nt, Artificial Sequence
  derived and/or modified sequence opt4 from hemagglutinin__InfluenzaA__AGB08296
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaccgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162283 - RNA, 1701 nt, Artificial Sequence
  derived and/or modified sequence opt4 from hemagglutinin__InfluenzaA__AGB08297
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcgagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaccgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162284 - RNA, 1701 nt, Artificial Sequence
  derived and/or modified sequence opt4 from hemagglutinin__InfluenzaA__AGB08298
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcaucgccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccagacugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaccgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccagcuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162285 - RNA, 1701 nt, Artificial Sequence
  derived and/or modified sequence opt4 from hemagglutinin__InfluenzaA__AGB08301
augaagaccaucaucgcccugagcuacauccugugccugguguucgcccaggagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccguggugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162286 - RNA, 1701 nt, Artificial Sequence
  derived and/or modified sequence opt4 from hemagglutinin__InfluenzaA__AGB08343
augaagaccaucaucgcccugagcuacaucuucugccuggugcuggcccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcaacaacccccacagaauccuggacggcaucaacugcacccugaucgacgcccugcugggcgacccccacugcgacggcuuccagaacaagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcuacgccugcaagagaggccccgacaacggcuucuucagcagacugaacuggcuguacaagagcgagagcaccuaccccgugcugaacgugaccaugcccaacaacgacaacuucgacaagcuguacaucuggggcgugcaccaccccagcaccgacaaggagcagaccaaccuguacgugcaggccagcggcagagugaccgugagcaccaagagaagccagcagaccaucauccccaacgugggcagcagacccugggugagaggccugagcagcagaaucagcaucuacuggaccaucgugaagcccggcgacauccuggugaucaacagcaacggcaaccugaucgcccccagaggcuacuucaagaucagaaacggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 162287 - RNA, 1701 nt, Artificial Sequence
  derived and/or modified sequence opt4 from hemagglutinin__InfluenzaA__AGB08362
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucaacugcacccugaucgacgcccugcugggcgacccccacugcgacguguuccaggacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgacaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 162288 - RNA, 1701 nt, Artificial Sequence; identical to SEQ ID NO: 159342
  derived and/or modified sequence opt4 from hemagglutinin__InfluenzaA__AGB12986

SEQ ID NO: 162289 - RNA, 1701 nt, Artificial Sequence; identical to SEQ ID NO: 159606
  derived and/or modified sequence opt4 from hemagglutinin__InfluenzaA__AGB13006

SEQ ID NO: 162290 - RNA, 1701 nt, Artificial Sequence
  derived and/or modified sequence opt4 from hemagglutinin__InfluenzaA__AGB13016
augaaggccauccugguggugcugcuguacaccaucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaucggcaaccugguggugcccagauacgccuucgccauggagaagaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcgccagaguguaccagauccuggccaucuacagcaccguggccagcagccuggugcugguggugagccugggcgccaucagcuucuggaugugcagcaacggcagccugcagugcagaaucugcaucuga

SEQ ID NO: 162291 - RNA, 1701 nt, Artificial Sequence; identical to SEQ ID NO: 159387
  derived and/or modified sequence opt4 from hemagglutinin__InfluenzaA__AGB13026

SEQ ID NO: 162292 - RNA, 1701 nt, Artificial Sequence; identical to SEQ ID NO: 159329
  derived and/or modified sequence opt4 from hemagglutinin__InfluenzaA__AGB13036

SEQ ID NO: 162293 - RNA, 1701 nt, Artificial Sequence
  derived and/or modified sequence opt4 from hemagglutinin__InfluenzaA__AGB13048
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcaucgagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162294 - RNA, 1701 nt, Artificial Sequence
  derived and/or modified sequence opt4 from hemagglutinin__InfluenzaA__AGB13066
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagggcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162295 - RNA, 1701 nt, Artificial Sequence; identical to SEQ ID NO: 159429
  derived and/or modified sequence opt4 from hemagglutinin__InfluenzaA__AGB13082

SEQ ID NO: 162296 - RNA, 1701 nt, Artificial Sequence; identical to SEQ ID NO: 159329
  derived and/or modified sequence opt4 from hemagglutinin__InfluenzaA__AGB13105

SEQ ID NO: 162297 - RNA, 1701 nt, Artificial Sequence; identical to SEQ ID NO: 159387
  derived and/or modified sequence opt4 from hemagglutinin__InfluenzaA__AGB13125

SEQ ID NO: 162298 - RNA, 1701 nt, Artificial Sequence; identical to SEQ ID NO: 159387
  derived and/or modified sequence opt4 from hemagglutinin__InfluenzaA__AGB13130

SEQ ID NO: 162299 - RNA, 1701 nt, Artificial Sequence
  derived and/or modified sequence opt4 from hemagglutinin__InfluenzaA__AGB13140
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagccuguggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162300 - RNA, 1701 nt, Artificial Sequence
  derived and/or modified sequence opt4 from hemagglutinin__InfluenzaA__AGB13159
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccagccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162301 - RNA, 1701 nt, Artificial Sequence; identical to SEQ ID NO: 159344
  derived and/or modified sequence opt4 from hemagglutinin__InfluenzaA__AGB13170

SEQ ID NO: 162302 - RNA, 1701 nt, Artificial Sequence
  derived and/or modified sequence opt4 from hemagglutinin__InfluenzaA__AGB13180
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacaccagcgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162303 - RNA, 1701 nt, Artificial Sequence; identical to SEQ ID NO: 159387
  derived and/or modified sequence opt4 from hemagglutinin__InfluenzaA__AGB13190

SEQ ID NO: 162304 - RNA, 1701 nt, Artificial Sequence
  derived and/or modified sequence opt4 from hemagglutinin__InfluenzaA__AGB13200
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgugaagagcuucuacaagaaccugaucuggcuggugaagaagggcaacagcuaccccaagcugagcaagagcuacaucaacgacaagggcaaggaggugcuggugcuguggggcauccaccaccccagcaccaccaccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162305 - RNA, 1701 nt, Artificial Sequence
  derived and/or modified sequence opt4 from hemagglutinin__InfluenzaA__AGB13210
augaaggccacccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162306 - RNA, 1701 nt, Artificial Sequence
  derived and/or modified sequence opt4 from hemagglutinin__InfluenzaA__AGB13220
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaucagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162307 - RNA, 1701 nt, Artificial Sequence
  derived and/or modified sequence opt4 from hemagglutinin__InfluenzaA__AGB13230
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaaccacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaacagacuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162308 - RNA, 1701 nt, Artificial Sequence; identical to SEQ ID NO: 159387
  derived and/or modified sequence opt4 from hemagglutinin__InfluenzaA__AGB13240

SEQ ID NO: 162309 - RNA, 1701 nt, Artificial Sequence; identical to SEQ ID NO: 159387
  derived and/or modified sequence opt4 from hemagglutinin__InfluenzaA__AGB13250

SEQ ID NO: 162310 - RNA, 1701 nt, Artificial Sequence
  derived and/or modified sequence opt4 from hemagglutinin__InfluenzaA__AGB13260
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccaccgccugcccccacgccggcagcaagagcuucuacaagaaccugaucuggcuggugaagaagggcaacagcuaccccaagcugagcaagagcuacaucaacgacaagggcaaggaggugcuggugcuguggggcauccaccacccccccaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcaucaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162311 - RNA, 1701 nt, Artificial Sequence
  derived and/or modified sequence opt4 from hemagglutinin__InfluenzaA__AGB13270
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162312 - RNA, 1701 nt, Artificial Sequence
  derived and/or modified sequence opt4 from hemagglutinin__InfluenzaA__AGB13280
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaacgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacggccagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162313 - RNA, 1701 nt, Artificial Sequence
  derived and/or modified sequence opt4 from hemagglutinin__InfluenzaA__AGB13290
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggugaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162314 - RNA, 1701 nt, Artificial Sequence; identical to SEQ ID NO: 159387
  derived and/or modified sequence opt4 from hemagglutinin__InfluenzaA__AGB13300

SEQ ID NO: 162315 - RNA, 1701 nt, Artificial Sequence
  derived and/or modified sequence opt4 from hemagglutinin__InfluenzaA__AGB13310
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcgugcaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162316 - RNA, 1701 nt, Artificial Sequence
  derived and/or modified sequence opt4 from hemagglutinin__InfluenzaA__AGB13320
augaaggccauccugguggugcugcuguacaccaucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagaagaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcgccagaguguaccagauccuggccaucuacagcaccguggccagcagccuggugcugguggugagccugggcgccaucagcuucuggaugugcagcaacggcagccugcagugcagaaucugcaucuga

SEQ ID NO: 162317 - RNA, 1701 nt, Artificial Sequence
  derived and/or modified sequence opt4 from hemagglutinin__InfluenzaA__AGB13330
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacagcaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162318 - RNA, 1701 nt, Artificial Sequence; identical to SEQ ID NO: 159387
  derived and/or modified sequence opt4 from hemagglutinin__InfluenzaA__AGB13340

SEQ ID NO: 162319 - RNA, 1701 nt, Artificial Sequence
  derived and/or modified sequence opt4 from hemagglutinin__InfluenzaA__AGB13350
augaaggccauccugguggugcugcuguacaccuucgccaccgccaacgccgacacccugugcaucggcuaccacgccaacaacagcaccgagaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccaggccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgcccagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162320 - RNA, 1701 nt, Artificial Sequence
  derived and/or modified sequence opt4 from hemagglutinin__InfluenzaA__AGB13360
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagaugcuggugcugcuggagaacgagaagacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162321 - RNA, 1701 nt, Artificial Sequence
  derived and/or modified sequence opt4 from hemagglutinin__InfluenzaA__AGB13380
augaaggccauccugguggugcugcuguacaccuucgccaccgccaaggccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaaccccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162322 - RNA, 1701 nt, Artificial Sequence; identical to SEQ ID NO: 158955
  derived and/or modified sequence opt4 from hemagglutinin__InfluenzaA__AGB13390

SEQ ID NO: 162323 - RNA, 1701 nt, Artificial Sequence; identical to SEQ ID NO: 159562
  derived and/or modified sequence opt4 from hemagglutinin__InfluenzaA__AGB13400

SEQ ID NO: 162324 - RNA, 1701 nt, Artificial Sequence; identical to SEQ ID NO: 158955
  derived and/or modified sequence opt4 from hemagglutinin__InfluenzaA__AGB13410

SEQ ID NO: 162325 - RNA, 1701 nt, Artificial Sequence; identical to SEQ ID NO: 158974
  derived and/or modified sequence opt4 from hemagglutinin__InfluenzaA__AGB13420

SEQ ID NO: 162326 - RNA, 1701 nt, Artificial Sequence
  derived and/or modified sequence opt4 from hemagglutinin__InfluenzaA__AGB13430
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagauguuccccaagaccagcagcuggcccaaccacgacagcaacaagggcgugaccaccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccacccccccaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccaugaucuaccagauccuggccaucuacagcaccguggccagcagccuggugcugguggugagccugggcgccaucagcuucuggaugugcagcaacggcagccugcagugcagaaucugcaucuga

SEQ ID NO: 162327 - RNA, 1701 nt, Artificial Sequence; identical to SEQ ID NO: 159562
  derived and/or modified sequence opt4 from hemagglutinin__InfluenzaA__AGB13440

SEQ ID NO: 162328 - RNA, 1701 nt, Artificial Sequence; identical to SEQ ID NO: 158974
  derived and/or modified sequence opt4 from hemagglutinin__InfluenzaA__AGB13450

SEQ ID NO: 162329 - RNA, 1701 nt, Artificial Sequence; identical to SEQ ID NO: 158955
  derived and/or modified sequence opt4 from hemagglutinin__InfluenzaA__AGB13460

SEQ ID NO: 162330 - RNA, 1701 nt, Artificial Sequence; identical to SEQ ID NO: 159387
  derived and/or modified sequence opt4 from hemagglutinin__InfluenzaA__AGB13470

SEQ ID NO: 162331 - RNA, 1701 nt, Artificial Sequence; identical to SEQ ID NO: 158974
  derived and/or modified sequence opt4 from hemagglutinin__InfluenzaA__AGB13480

SEQ ID NO: 162332 - RNA, 1701 nt, Artificial Sequence; identical to SEQ ID NO: 159387
  derived and/or modified sequence opt4 from hemagglutinin__InfluenzaA__AGB13490

SEQ ID NO: 162333 - RNA, 1701 nt, Artificial Sequence
  derived and/or modified sequence opt4 from hemagglutinin__InfluenzaA__AGB13500
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcaacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggcccccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162334 - RNA, 1701 nt, Artificial Sequence; identical to SEQ ID NO: 159592
  derived and/or modified sequence opt4 from hemagglutinin__InfluenzaA__AGB13520

SEQ ID NO: 162335 - RNA, 1701 nt, Artificial Sequence
  derived and/or modified sequence opt4 from hemagglutinin__InfluenzaA__AGB13530
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaacaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucaacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162336 - RNA, 1701 nt, Artificial Sequence; identical to SEQ ID NO: 159606
  derived and/or modified sequence opt4 from hemagglutinin__InfluenzaA__AGB13540

SEQ ID NO: 162337 - RNA, 1701 nt, Artificial Sequence; identical to SEQ ID NO: 159570
  derived and/or modified sequence opt4 from hemagglutinin__InfluenzaA__AGB13550

SEQ ID NO: 162338 - RNA, 1701 nt, Artificial Sequence; identical to SEQ ID NO: 159570
  derived and/or modified sequence opt4 from hemagglutinin__InfluenzaA__AGB13560

SEQ ID NO: 162339 - RNA, 1701 nt, Artificial Sequence; identical to SEQ ID NO: 159387
  derived and/or modified sequence opt4 from hemagglutinin__InfluenzaA__AGB13570

SEQ ID NO: 162340 - RNA, 1701 nt, Artificial Sequence
  derived and/or modified sequence opt4 from hemagglutinin__InfluenzaA__AGB13580
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcaacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162341 - RNA, 1701 nt, Artificial Sequence
  derived and/or modified sequence opt4 from hemagglutinin__InfluenzaA__AGB13590
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162342 - RNA, 1701 nt, Artificial Sequence
  derived and/or modified sequence opt4 from hemagglutinin__InfluenzaA__AGB13600
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaacaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162343 - RNA, 1701 nt, Artificial Sequence; identical to SEQ ID NO: 159387
  derived and/or modified sequence opt4 from hemagglutinin__InfluenzaA__AGB13610

SEQ ID NO: 162344 - RNA, 1701 nt, Artificial Sequence; identical to SEQ ID NO: 159606
  derived and/or modified sequence opt4 from hemagglutinin__InfluenzaA__AGB13620

SEQ ID NO: 162345 - RNA, 1701 nt, Artificial Sequence; identical to SEQ ID NO: 158974
  derived and/or modified sequence opt4 from hemagglutinin__InfluenzaA__AGB13630

SEQ ID NO: 162346 - RNA, 1701 nt, Artificial Sequence
  derived and/or modified sequence opt4 from hemagglutinin__InfluenzaA__AGB13640
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccaccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccacccccccaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccaugaucuaccagauccuggccaucuacagcaccguggccagcagccuggugcugaucgugagccugggcgccaucagcuucuggaugugcagcaacggcagccugcagugcagaaucugcaucuga

SEQ ID NO: 162347 - RNA, 1701 nt, Artificial Sequence
  derived and/or modified sequence opt4 from hemagglutinin__InfluenzaA__AGB13650
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccaccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccacccccccaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcugauccugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccaugaucuaccagauccuggccaucuacagcaccguggccagcagccuggugcugaucgugagccugggcgccaucagcuucuggaugugcagcaacggcagccugcagugcagaaucugcaucuga

SEQ ID NO: 162348 - RNA, 1701 nt, Artificial Sequence; identical to SEQ ID NO: 159344
  derived and/or modified sequence opt4 from hemagglutinin__InfluenzaA__AGB13660

SEQ ID NO: 162349 - RNA, 1701 nt, Artificial Sequence; identical to SEQ ID NO: 158955
  derived and/or modified sequence opt4 from hemagglutinin__InfluenzaA__AGB13721

SEQ ID NO: 162350 - RNA, 1701 nt, Artificial Sequence; identical to SEQ ID NO: 159387
  derived and/or modified sequence opt4 from hemagglutinin__InfluenzaA__AGB13731

SEQ ID NO: 162351 - RNA, 1701 nt, Artificial Sequence
  derived and/or modified sequence opt4 from hemagglutinin__InfluenzaA__AGB51356
augaaggccauccugcuggugcugcugugcaccuucgccgccaccaacgccgacacccugugcaucggcuaccacgccaacaacagcaccgacaccguggacaccgugcuggagaagaacgugaccgugacccacagcgugaaccugcuggaggacagacacaacggcaagcugugcaagcugggcggcaucgccccccugcaccugggcaagugcaacaucgccggcuggcugcugggcaaccccgagugcgagcugcugcugaccgugagcagcuggagcuacaucguggagaccagcaacagcgacaacggcaccugcuaccccggcgacuucaucaacuacgaggagcugagagagcagcugagcagcgugagcagcuucgagagauucgagaucuuccccaagaccagcagcuggcccaaccacgagaccaacagaggcgugaccgccgccugccccuacgccggcgccaacagcuucuacagaaaccugaucuggcugguggagaagggcaacagcuaccccaagcugagcaagagcuacgugaacaacaagggcaaggaggugcuggugcuguggggcauccaccacccccccaccagcaccgaccagcagagccuguaccagaacgccgacgccuacguguucgugggcagcagcaaguacaacagaaaguucaagcccgagaucgccgccagacccaaggugagaggccaggccggcagaaugaacuacuacuggacccugaucgagcccggcgacaccaucaccuucgaggccaccggcaaccugguggugcccagauacgccuucgccaugaacagaggcagcggcagcggcaucaucaucagcgacgcccccgugcacgacugcaacaccaagugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagagaagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuuccacgacagcaacgugaagaaccuguacgagaaggugagaagccagcugagaaacaacgccaaggagaucggcaacggcugcuucgaguucuaccacaagugcgacgacaccugcauggagagcgugaagaacggcaccuacgacuaccccaaguacagcgaggagagcaagcugaacagagaggagaucgacggcgugaagcuggagagcaccagaaucuaccagauccuggccaucuacagcaccguggccagcagccuggugcugcuggugagccugggcgccaucagcuucuggaugugcagcaacggcagccugcagugcagaaucugcaucuga

SEQ ID NO: 162352 - RNA, 1701 nt, Artificial Sequence
  derived and/or modified sequence opt4 from hemagglutinin__InfluenzaA__AGB97269
augaaggccauccugguggugcugcuguacaccuucgccaccgccaacgccgacacccugugcaucggcuaccacgccaacaacagcaccgacaccguggacaccgugcuggagaagaacaucaccgugacccacagcgugaaccugcuggaggacaagcacaacggcaagcugugcaagcugagaggcguggccccccugcaccugggcaagugcaacaucgccggcuggauccugggcaaccccgagugcgagacccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 162353 - RNA, 1701 nt, Artificial Sequence; identical to SEQ ID NO: 160706
  derived and/or modified sequence opt4 from hemagglutinin__InfluenzaA__AGB97273

SEQ ID NO: 162354 - RNA, 1701 nt, Artificial Sequence
  derived and/or modified sequence opt4 from hemagglutinin__InfluenzaA__AGB97288
augaagaccaucaucgcccugggcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucaucgagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgccaagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162355 - RNA, 1701 nt, Artificial Sequence
  derived and/or modified sequence opt4 from hemagglutinin__InfluenzaA__AGB97292
augaagaccaucaucgcccugagcuacauccugugccugguguucgcccaggagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162356 - RNA, 1701 nt, Artificial Sequence
  derived and/or modified sequence opt4 from hemagglutinin__InfluenzaA__AGB97300
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162357 - RNA, 1701 nt, Artificial Sequence
  derived and/or modified sequence opt4 from hemagglutinin__InfluenzaA__AGE89267
augaaggccauccugaucgugcugcuguacaccuucgccaccgccaacgccgacacccugugcaucggcuaccacgccaacaacagcaccgacaccguggacaccgugcuggagaagaacgugaccgugacccacagcguggaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgagaagagcuucuacaagaaccugaucuggcuggugaagaagggcaacagcuaccccaagcugaacaagagcuacaucaacgacaagggcaaggaggugcuggugcuguggggcauccaccaccccagcaccagcaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccauccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugaagagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162358 - RNA, 1701 nt, Artificial Sequence
  derived and/or modified sequence opt4 from hemagglutinin__InfluenzaA__AGE89277
augaaggccauccugaucgugcugcuguacaccuucgccaccgccaacgccgacacccugugcaucggcuaccacgccaacaacagcaccgacaccguggacaccgugcuggagaagaacgugaccgugacccacagcguggaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugaacagcgugagcagcuucgagagauucgagaucuuccccaagaccagcagcuggcccaaccacgacagcaacaagggcgugaccgccgccugcccccacgccggcgagaagagcuucuacaagaaccugaucuggcuggugaagaagggcaacagcuaccccaagcugaacaagagcuacaucaacgacaagggcaaggaggugcuggugcuguggggcauccaccaccccagcaccagcaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccauccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugaagagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162359 - RNA, 1701 nt, Artificial Sequence; identical to SEQ ID NO: 160876
  derived and/or modified sequence opt4 from hemagglutinin__InfluenzaA__AGE89287

SEQ ID NO: 162360 - RNA, 1701 nt, Artificial Sequence
  derived and/or modified sequence opt4 from hemagglutinin__InfluenzaA__AGE89298
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccugauccugguggugagccugggcgccaucagcuucuggaugugcagcaacggcagccugcagugcagaaucugcaucuga

SEQ ID NO: 162361 - RNA, 1701 nt, Artificial Sequence; identical to SEQ ID NO: 159429
  derived and/or modified sequence opt4 from hemagglutinin__InfluenzaA__AGE89308

SEQ ID NO: 162362 - RNA, 1701 nt, Artificial Sequence; identical to SEQ ID NO: 160871
  derived and/or modified sequence opt4 from hemagglutinin__InfluenzaA__AGE89318

SEQ ID NO: 162363 - RNA, 1701 nt, Artificial Sequence
  derived and/or modified sequence opt4 from hemagglutinin__InfluenzaA__AGE89329
augaagaccaucaucgcccugagcuacauccugugccugguguucgcccagaagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162364 - RNA, 1701 nt, Artificial Sequence; identical to SEQ ID NO: 158974
  derived and/or modified sequence opt4 from hemagglutinin__InfluenzaA__AGE89340

SEQ ID NO: 162365 - RNA, 1701 nt, Artificial Sequence; identical to SEQ ID NO: 160874
  derived and/or modified sequence opt4 from hemagglutinin__InfluenzaA__AGE89350

SEQ ID NO: 162366 - RNA, 1701 nt, Artificial Sequence
  derived and/or modified sequence opt4 from hemagglutinin__InfluenzaA__AGE89361
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162367 - RNA, 1701 nt, Artificial Sequence; identical to SEQ ID NO: 160871
  derived and/or modified sequence opt4 from hemagglutinin__InfluenzaA__AGE89371

SEQ ID NO: 162368 - RNA, 1701 nt, Artificial Sequence
  derived and/or modified sequence opt4 from hemagglutinin__InfluenzaA__AGE89382
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccuggugaagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162369 - RNA, 1701 nt, Artificial Sequence
  derived and/or modified sequence opt4 from hemagglutinin__InfluenzaA__AGE89392
augaagaccaucaucgcccugagcuacauccugugccugguguucgcccaggagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162370 - RNA, 1701 nt, Artificial Sequence; identical to SEQ ID NO: 162357
  derived and/or modified sequence opt4 from hemagglutinin__InfluenzaA__AGE89422

SEQ ID NO: 162371 - RNA, 1701 nt, Artificial Sequence; identical to SEQ ID NO: 160854
  derived and/or modified sequence opt4 from hemagglutinin__InfluenzaA__AGE89719

SEQ ID NO: 162372 - RNA, 1701 nt, Artificial Sequence
  derived and/or modified sequence opt4 from hemagglutinin__InfluenzaA__AGE89730
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacggccagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162373 - RNA, 1701 nt, Artificial Sequence; identical to SEQ ID NO: 160871
  derived and/or modified sequence opt4 from hemagglutinin__InfluenzaA__AGE89740

SEQ ID NO: 162374 - RNA, 1701 nt, Artificial Sequence
  derived and/or modified sequence opt4 from hemagglutinin__InfluenzaA__AGE89751
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcgccggcgagaucugcgacagcccccaccacauccuggacggcgagaacugcacccugaucgacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggccauggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugagcaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162375 - RNA, 1701 nt, Artificial Sequence; identical to SEQ ID NO: 160874
  derived and/or modified sequence opt4 from hemagglutinin__InfluenzaA__AGE89762

SEQ ID NO: 162376 - RNA, 1701 nt, Artificial Sequence
  derived and/or modified sequence opt4 from hemagglutinin__InfluenzaA__AGF44891
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccguggacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162377 - RNA, 1701 nt, Artificial Sequence; identical to SEQ ID NO: 162376
  derived and/or modified sequence opt4 from hemagglutinin__InfluenzaA__AGF44892

SEQ ID NO: 162378 - RNA, 1701 nt, Artificial Sequence
  derived and/or modified sequence opt4 from hemagglutinin__InfluenzaA__AGF44895
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162379 - RNA, 1701 nt, Artificial Sequence; identical to SEQ ID NO: 162355
  derived and/or modified sequence opt4 from hemagglutinin__InfluenzaA__AGF44896

SEQ ID NO: 162380 - RNA, 1701 nt, Artificial Sequence
  derived and/or modified sequence opt4 from hemagglutinin__InfluenzaA__AGF44897
augaagaccaucaucgcccugagcuacauccugugccugguguucgcccaggagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaugagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162381 - RNA, 1701 nt, Artificial Sequence; identical to SEQ ID NO: 162378
  derived and/or modified sequence opt4 from hemagglutinin__InfluenzaA__AGF44900

SEQ ID NO: 162382 - RNA, 1701 nt, Artificial Sequence; identical to SEQ ID NO: 162378
  derived and/or modified sequence opt4 from hemagglutinin__InfluenzaA__AGF44901

SEQ ID NO: 162383 - RNA, 1701 nt, Artificial Sequence; identical to SEQ ID NO: 162378
  derived and/or modified sequence opt4 from hemagglutinin__InfluenzaA__AGF44902

SEQ ID NO: 162384 - RNA, 1701 nt, Artificial Sequence; identical to SEQ ID NO: 162378
  derived and/or modified sequence opt4 from hemagglutinin__InfluenzaA__AGF44903

SEQ ID NO: 162385 - RNA, 1701 nt, Artificial Sequence; identical to SEQ ID NO: 162378
  derived and/or modified sequence opt4 from hemagglutinin__InfluenzaA__AGF44904

SEQ ID NO: 162386 - RNA, 1701 nt, Artificial Sequence
  derived and/or modified sequence opt4 from hemagglutinin__InfluenzaA__AGF44905
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaacaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162387 - RNA, 1701 nt, Artificial Sequence; identical to SEQ ID NO: 162378
  derived and/or modified sequence opt4 from hemagglutinin__InfluenzaA__AGF44906

SEQ ID NO: 162388 - RNA, 1701 nt, Artificial Sequence
  derived and/or modified sequence opt4 from hemagglutinin__InfluenzaA__AGF44908
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162389 - RNA, 1701 nt, Artificial Sequence; identical to SEQ ID NO: 162378
  derived and/or modified sequence opt4 from hemagglutinin__InfluenzaA__AGF44909

SEQ ID NO: 162390 - RNA, 1701 nt, Artificial Sequence; identical to SEQ ID NO: 162378
  derived and/or modified sequence opt4 from hemagglutinin__InfluenzaA__AGF44910

SEQ ID NO: 162391 - RNA, 1701 nt, Artificial Sequence
  derived and/or modified sequence opt4 from hemagglutinin__InfluenzaA__AGF44911
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaccagcugcuuccugcugugcguggcccugcugggcuucaucaugugggccugccagaagggcaacaucagaugcaacaucugcaucuga

SEQ ID NO: 162392 - RNA, 1701 nt, Artificial Sequence; identical to SEQ ID NO: 162378
  derived and/or modified sequence opt4 from hemagglutinin__InfluenzaA__AGF44912

SEQ ID NO: 162393 - RNA, 1701 nt, Artificial Sequence; identical to SEQ ID NO: 162378
  derived and/or modified sequence opt4 from hemagglutinin__InfluenzaA__AGF44913

SEQ ID NO: 162394 - RNA, 1701 nt, Artificial Sequence
  derived and/or modified sequence opt4 from hemagglutinin__InfluenzaA__AGF44914
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacaagaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162395 - RNA, 1701 nt, Artificial Sequence; identical to SEQ ID NO: 162355
  derived and/or modified sequence opt4 from hemagglutinin__InfluenzaA__AGF44916

SEQ ID NO: 162396 - RNA, 1701 nt, Artificial Sequence
  derived and/or modified sequence opt4 from hemagglutinin__InfluenzaA__AGF44917
augaagaccaucaucgcccugagcuacauccugugccugguguucgcccagaagauccccggcaacgacaacagcaccgccacccugugccugggccaccacgccgugcccaacggcaccaucgugaagaccaucaccaacgagcagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcgacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162397 - RNA, 1701 nt, Artificial Sequence; identical to SEQ ID NO: 162355
  derived and/or modified sequence opt4 from hemagglutinin__InfluenzaA__AGF44918

SEQ ID NO: 162398 - RNA, 1701 nt, Artificial Sequence
  derived and/or modified sequence opt4 from hemagglutinin__InfluenzaA__AGF44919
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacuacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162399 - RNA, 1701 nt, Artificial Sequence; identical to SEQ ID NO: 162355
  derived and/or modified sequence opt4 from hemagglutinin__InfluenzaA__AGF44920

SEQ ID NO: 162400 - RNA, 1701 nt, Artificial Sequence; identical to SEQ ID NO: 162378
  derived and/or modified sequence opt4 from hemagglutinin__InfluenzaA__AGF44921

SEQ ID NO: 162401 - RNA, 1701 nt, Artificial Sequence
  derived and/or modified sequence opt4 from hemagglutinin__InfluenzaA__AGG13411
augaagaccaucaucgcccugagcuacauccugugccugguguucgcccaggagcugcccggcaacgacgacagcaccgccacccugugccugggccaccacgccgugcccaacggcaccaucgugaagaccaucaccaacgacagaaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaaaccagcagaccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162402 - RNA, 1701 nt, Artificial Sequence
  derived and/or modified sequence opt4 from hemagglutinin__InfluenzaA__AGG13447
augaagaccaucaucgcccugagcuacauccugugccugguguucgcccaggagcugcccggcaacgacgacagcaccgccacccugugccugggccaccacgccgugcccaacggcaccaucgugaagaccaucaccaacgacagaaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagacccagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162403 - RNA, 1701 nt, Artificial Sequence
  derived and/or modified sequence opt4 from hemagglutinin__InfluenzaA__AGG13459
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162404 - RNA, 1701 nt, Artificial Sequence
  derived and/or modified sequence opt4 from hemagglutinin__InfluenzaA__AGG13495
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcgacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagagcgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162405 - RNA, 1701 nt, Artificial Sequence; identical to SEQ ID NO: 162403
  derived and/or modified sequence opt4 from hemagglutinin__InfluenzaA__AGG13507

SEQ ID NO: 162406 - RNA, 1701 nt, Artificial Sequence
  derived and/or modified sequence opt4 from hemagglutinin__InfluenzaA__AGG13519
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcgacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagagcgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagagugcaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162407 - RNA, 1701 nt, Artificial Sequence; identical to SEQ ID NO: 162403
  derived and/or modified sequence opt4 from hemagglutinin__InfluenzaA__AGG13531

SEQ ID NO: 162408 - RNA, 1701 nt, Artificial Sequence
  derived and/or modified sequence opt4 from hemagglutinin__InfluenzaA__AGG13543
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggacaucgagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162409 - RNA, 1701 nt, Artificial Sequence; identical to SEQ ID NO: 162403
  derived and/or modified sequence opt4 from hemagglutinin__InfluenzaA__AGG13555

SEQ ID NO: 162410 - RNA, 1701 nt, Artificial Sequence; identical to SEQ ID NO: 162403
  derived and/or modified sequence opt4 from hemagglutinin__InfluenzaA__AGG13567

SEQ ID NO: 162411 - RNA, 1701 nt, Artificial Sequence
  derived and/or modified sequence opt4 from hemagglutinin__InfluenzaA__AGG13591
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagaacuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacagacccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162412 - RNA, 1701 nt, Artificial Sequence
  derived and/or modified sequence opt4 from hemagglutinin__InfluenzaA__AGG13615
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccagcgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162413 - RNA, 1701 nt, Artificial Sequence; identical to SEQ ID NO: 162411
  derived and/or modified sequence opt4 from hemagglutinin__InfluenzaA__AGG13627

SEQ ID NO: 162414 - RNA, 1701 nt, Artificial Sequence
  derived and/or modified sequence opt4 from hemagglutinin__InfluenzaA__AGG13639
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccaacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162415 - RNA, 1701 nt, Artificial Sequence; identical to SEQ ID NO: 162404
  derived and/or modified sequence opt4 from hemagglutinin__InfluenzaA__AGG13651

SEQ ID NO: 162416 - RNA, 1701 nt, Artificial Sequence; identical to SEQ ID NO: 162403
  derived and/or modified sequence opt4 from hemagglutinin__InfluenzaA__AGG13663

SEQ ID NO: 162417 - RNA, 1701 nt, Artificial Sequence; identical to SEQ ID NO: 162404
  derived and/or modified sequence opt4 from hemagglutinin__InfluenzaA__AGG13675

SEQ ID NO: 162418 - RNA, 1701 nt, Artificial Sequence; identical to SEQ ID NO: 162403
  derived and/or modified sequence opt4 from hemagglutinin__InfluenzaA__AGG13687

SEQ ID NO: 162419 - RNA, 1701 nt, Artificial Sequence; identical to SEQ ID NO: 162404
  derived and/or modified sequence opt4 from hemagglutinin__InfluenzaA__AGG13711

SEQ ID NO: 162420 - RNA, 1701 nt, Artificial Sequence; identical to SEQ ID NO: 162403
  derived and/or modified sequence opt4 from hemagglutinin__InfluenzaA__AGG13723

SEQ ID NO: 162421 - RNA, 1701 nt, Artificial Sequence; identical to SEQ ID NO: 162403
  derived and/or modified sequence opt4 from hemagglutinin__InfluenzaA__AGG13735

SEQ ID NO: 162422 - RNA, 1701 nt, Artificial Sequence; identical to SEQ ID NO: 162403
  derived and/or modified sequence opt4 from hemagglutinin__InfluenzaA__AGG13747

SEQ ID NO: 162423 - RNA, 1701 nt, Artificial Sequence
  derived and/or modified sequence opt4 from hemagglutinin__InfluenzaA__AGG13759
augaagaccaucaucgcccugagcuacauccugugccugguguucgcccaggagcugcccggcaacgacgacagcaccgccacccugugccugggccaccacgccgugcccaacggcaccaucgugaagaccaucaccaacgacagaaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162424 - RNA, 1701 nt, Artificial Sequence
  derived and/or modified sequence opt4 from hemagglutinin__InfluenzaA__AGG13771
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcgacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagagcgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaacaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162425 - RNA, 1701 nt, Artificial Sequence
  derived and/or modified sequence opt4 from hemagglutinin__InfluenzaA__AGG13783
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaugggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162426 - RNA, 1701 nt, Artificial Sequence; identical to SEQ ID NO: 162404
  derived and/or modified sequence opt4 from hemagglutinin__InfluenzaA__AGG13795

SEQ ID NO: 162427 - RNA, 1701 nt, Artificial Sequence; identical to SEQ ID NO: 162355
  derived and/or modified sequence opt4 from hemagglutinin__InfluenzaA__AGG13807

SEQ ID NO: 162428 - RNA, 1701 nt, Artificial Sequence; identical to SEQ ID NO: 162404
  derived and/or modified sequence opt4 from hemagglutinin__InfluenzaA__AGG13819

SEQ ID NO: 162429 - RNA, 1701 nt, Artificial Sequence; identical to SEQ ID NO: 162404
  derived and/or modified sequence opt4 from hemagglutinin__InfluenzaA__AGG13831

SEQ ID NO: 162430 - RNA, 1701 nt, Artificial Sequence; identical to SEQ ID NO: 162403
  derived and/or modified sequence opt4 from hemagglutinin__InfluenzaA__AGG13855

SEQ ID NO: 162431 - RNA, 1701 nt, Artificial Sequence
  derived and/or modified sequence opt4 from hemagglutinin__InfluenzaA__AGG13867
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcaagaucugcgacagcccccaccagauccuggacggcgagaacugcacccugauggacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162432 - RNA, 1701 nt, Artificial Sequence; identical to SEQ ID NO: 162403
  derived and/or modified sequence opt4 from hemagglutinin__InfluenzaA__AGG13879

SEQ ID NO: 162433 - RNA, 1701 nt, Artificial Sequence; identical to SEQ ID NO: 162403
  derived and/or modified sequence opt4 from hemagglutinin__InfluenzaA__AGG13891

SEQ ID NO: 162434 - RNA, 1701 nt, Artificial Sequence
  derived and/or modified sequence opt4 from hemagglutinin__InfluenzaA__AGG13903
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcgacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagagcgugcugcccaacaucggcagcagacccagaaucagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162435 - RNA, 1701 nt, Artificial Sequence; identical to SEQ ID NO: 162403
  derived and/or modified sequence opt4 from hemagglutinin__InfluenzaA__AGG13927

SEQ ID NO: 162436 - RNA, 1701 nt, Artificial Sequence; identical to SEQ ID NO: 162411
  derived and/or modified sequence opt4 from hemagglutinin__InfluenzaA__AGG13939

SEQ ID NO: 162437 - RNA, 1701 nt, Artificial Sequence
  derived and/or modified sequence opt4 from hemagglutinin__InfluenzaA__AGG13962
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagggcuucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccgagagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162438 - RNA, 1701 nt, Artificial Sequence; identical to SEQ ID NO: 162403
  derived and/or modified sequence opt4 from hemagglutinin__InfluenzaA__AGG13973

SEQ ID NO: 162439 - RNA, 1701 nt, Artificial Sequence; identical to SEQ ID NO: 162403
  derived and/or modified sequence opt4 from hemagglutinin__InfluenzaA__AGG13985

SEQ ID NO: 162440 - RNA, 1701 nt, Artificial Sequence; identical to SEQ ID NO: 162403
  derived and/or modified sequence opt4 from hemagglutinin__InfluenzaA__AGG13997

SEQ ID NO: 162441 - RNA, 1701 nt, Artificial Sequence; identical to SEQ ID NO: 162403
  derived and/or modified sequence opt4 from hemagglutinin__InfluenzaA__AGG14009

SEQ ID NO: 162442 - RNA, 1701 nt, Artificial Sequence
  derived and/or modified sequence opt4 from hemagglutinin__InfluenzaA__AGG14021
augaagaccaucaucgcccugagcuacauccugugccugguguucgcccaggagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcaucgagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162443 - RNA, 1701 nt, Artificial Sequence; identical to SEQ ID NO: 162404
  derived and/or modified sequence opt4 from hemagglutinin__InfluenzaA__AGG14033

SEQ ID NO: 162444 - RNA, 1701 nt, Artificial Sequence; identical to SEQ ID NO: 162423
  derived and/or modified sequence opt4 from hemagglutinin__InfluenzaA__AGG14318

SEQ ID NO: 162445 - RNA, 1701 nt, Artificial Sequence
  derived and/or modified sequence opt4 from hemagglutinin__InfluenzaA__AGG14330
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaucagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162446 - RNA, 1701 nt, Artificial Sequence
  derived and/or modified sequence opt4 from hemagglutinin__InfluenzaA__AGG84179
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcgccagcgagaucugcgacagcccccaccacauccuggacggcgagaacugcacccugaucgacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162447 - RNA, 1704 nt, Artificial Sequence
  derived and/or modified sequence opt4 from hemagglutinin__InfluenzaA__AGI02564
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccaccaacgaccugugcuaccccggcaacuucaacgacuacgaggagcugaagcaccugcugagcagaaucaaccacuucgagaagauccagaucauccccaagagcagcuggagcggccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagaaacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 162448 - RNA, 1707 nt, Artificial Sequence
  derived and/or modified sequence opt4 from hemagglutinin__InfluenzaA__AGI02565
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccauccccgccaacgaccugugcuaccccggcgacuucaacgacuacgaggagcugaagcaccugcugagcagaaucaaccacuucgagaagauccagaucauccccaagagcagcuggagcaaccacgaggccagccugggcgugagcagcgccugccccuaccugggcaagcccagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 162449 - RNA, 1704 nt, Artificial Sequence
  derived and/or modified sequence opt4 from hemagglutinin__InfluenzaA__AGI02566
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggagaaccugcugauccuguggggcauccaccacagcaacgacgccgccgagcagaucaagcuguaccagaaccccaccaccuacaucagcgugggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaaggagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 162450 - RNA, 1707 nt, Artificial Sequence
  derived and/or modified sequence opt4 from hemagglutinin__InfluenzaA__AGI02567
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcagaagcagcuucuucagaaacgugguguggcugaucaagaagaacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 162451 - RNA, 1704 nt, Artificial Sequence
  derived and/or modified sequence opt4 from hemagglutinin__InfluenzaA__AGI02568
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggagaaccugcugauccuguggggcauccaccacagcaacgacgccaccgagcagaucaagcuguaccagaaccccaccaccuacaucagcgugggcaccagcacccugaaccagagacuggugcccaagaucggcaccagaagcaaggugaacggccagagcggcagaauggacuucuucuggaccauccugaagcccaacgacgccaucaacuucgagagcaacggcaacuucaucgcccccgaguacgccuacaagaucgugaaggagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaugggcaucuaccagauccugagcaucuacagcaccguggccagcagccuggcccuggccaucaugguggccggccugagccuguggaugugcagcaacggcagccugcagugcagaaucugcaucuga

SEQ ID NO: 162452 - RNA, 1683 nt, Artificial Sequence
  derived and/or modified sequence opt4 from hemagglutinin__InfluenzaA__AGI60301
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgccaccagcgccugcagaagaagcggcagcagcuucuacgccgagaugaaguggcugcugagcaacaccgacaacgccgccuucccccagaugaccaagagcuacaagaacaccagaaagagccccgcccugaucguguggggcauccaccacagcgugagcaccgccgagcagaccaagcuguacggcagcggcaacaagcuggugaccgugggcagcagcaacuaccagcagagcuucgugcccagccccggcgccagaccccaggugaacggcaucagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagagccgugggcaagugccccagauacgugaagcagagaagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaacgagguggagaagcagaucggcaacgugaucaacuggaccagagacagcaucaccgagguguggagcuacaacgccgagcugcugguggccauggagaaccagcacaccaucgaccuggccgacagcgagauggacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgugaugggccugguguucaucugcgugaagaacggcaacaugagaugcaccaucugcaucuga

SEQ ID NO: 162453 - RNA, 1683 nt, Artificial Sequence
  derived and/or modified sequence opt4 from hemagglutinin__InfluenzaA__AGJ72861
augaacacccagauccugguguucgcccugaucgccaucauccccaccaacgccgacaagaucugccugggccaccacgccgugagcaacggcaccaaggugaacacccugaccgagagaggcggcgagguggugaacgccaccgagaccguggagagaaccaacauccccagaaucugcagcaagggcaagaagaccguggaccugggccagggcggccccagaggcaccaucaccggccccccccagugcgaccaguuccuggaguucagcgccgaccugaucauggagagaagagagggcagcgacgugugcuaccccggcaaguucgugaacgaggaggcccugagacagauccugagagagagcggcggcaucgacaaggaggccaugggcuucaccuacagcggcaucagaaccaacggcgccaccagcgccugcagaagaagcggcagcagcuucuacgccgagaugaaguggcugcugagcaacaccgacaacgccgccuucccccagaugaccaagagcuacaagaacaccagaaagagccccgcccugaucguguggggcauccaccacagcgugagcaccgccgagcagaccaagcuguacggcagcggcaacaagcuggugaccgugggcagcagcaacuaccagcagagcuucgugcccagccccggcgccagaccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagagccgugggcaagugccccagauacgugaagcagagaagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaacgagguggagaagcagaucggcaacgugaucaacuggaccagagacagcaucaccgagguguggagcuacaacgccgagcugcugguggccauggagaaccagcacaccaucgaccuggccgacagcgagauggacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgugaugggccugguguucaucugcgugaagaacggcaacaugagaugcaccaucugcaucuga

SEQ ID NO: 162454 - RNA, 1701 nt, Artificial Sequence
  derived and/or modified sequence opt4 from hemagglutinin__InfluenzaA__AGJ73327
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccaccagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucauccccgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagcuggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgagaucagcuucuggaugugcagcaacggcagccugcagugcagaaucugcaucuga

SEQ ID NO: 162455 - RNA, 1701 nt, Artificial Sequence
  derived and/or modified sequence opt4 from hemagglutinin__InfluenzaA__AGJ73329
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacgcccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162456 - RNA, 1701 nt, Artificial Sequence
  derived and/or modified sequence opt4 from hemagglutinin__InfluenzaA__AGJ73331
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccaccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccacccccccaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaaggugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162457 - RNA, 1701 nt, Artificial Sequence
  derived and/or modified sequence opt4 from hemagglutinin__InfluenzaA__AGJ73333
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162458 - RNA, 1701 nt, Artificial Sequence
  derived and/or modified sequence opt4 from hemagglutinin__InfluenzaA__AGJ73335
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccagagacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162459 - RNA, 1701 nt, Artificial Sequence; identical to SEQ ID NO: 158974
  derived and/or modified sequence opt4 from hemagglutinin__InfluenzaA__AGJ73337

SEQ ID NO: 162460 - RNA, 1701 nt, Artificial Sequence; identical to SEQ ID NO: 158974
  derived and/or modified sequence opt4 from hemagglutinin__InfluenzaA__AGJ73339

SEQ ID NO: 162461 - RNA, 1701 nt, Artificial Sequence; identical to SEQ ID NO: 158974
  derived and/or modified sequence opt4 from hemagglutinin__InfluenzaA__AGJ73341

SEQ ID NO: 162462 - RNA, 1701 nt, Artificial Sequence
  derived and/or modified sequence opt4 from hemagglutinin__InfluenzaA__AGJ73343
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcagaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162463 - RNA, 1701 nt, Artificial Sequence
  derived and/or modified sequence opt4 from hemagglutinin__InfluenzaA__AGJ73345
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgaggacgccuacguguucgugggcaccagcaaguacagcaagaaguucaagcccgagaucgccgugagacccaaggugagagaccaggagggcagaaugaacuacuacuggacccugguggagcccggcaacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162464 - RNA, 1701 nt, Artificial Sequence; identical to SEQ ID NO: 159570
  derived and/or modified sequence opt4 from hemagglutinin__InfluenzaA__AGJ73347

SEQ ID NO: 162465 - RNA, 1701 nt, Artificial Sequence; identical to SEQ ID NO: 159570
  derived and/or modified sequence opt4 from hemagglutinin__InfluenzaA__AGJ73349

SEQ ID NO: 162466 - RNA, 1701 nt, Artificial Sequence
  derived and/or modified sequence opt4 from hemagglutinin__InfluenzaA__AGJ73351
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaagaugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162467 - RNA, 1701 nt, Artificial Sequence
  derived and/or modified sequence opt4 from hemagglutinin__InfluenzaA__AGJ73353
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagagcauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162468 - RNA, 1701 nt, Artificial Sequence
  derived and/or modified sequence opt4 from hemagglutinin__InfluenzaA__AGJ73355
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaccagcuucuggaugugcagcaacggcagccugcagugcagaaucugcaucuga

SEQ ID NO: 162469 - RNA, 1701 nt, Artificial Sequence; identical to SEQ ID NO: 159387
  derived and/or modified sequence opt4 from hemagglutinin__InfluenzaA__AGJ73357

SEQ ID NO: 162470 - RNA, 1701 nt, Artificial Sequence
  derived and/or modified sequence opt4 from hemagglutinin__InfluenzaA__AGJ73361
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccagcagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucuucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162471 - RNA, 1701 nt, Artificial Sequence; identical to SEQ ID NO: 159570
  derived and/or modified sequence opt4 from hemagglutinin__InfluenzaA__AGJ73363

SEQ ID NO: 162472 - RNA, 1701 nt, Artificial Sequence; identical to SEQ ID NO: 159387
  derived and/or modified sequence opt4 from hemagglutinin__InfluenzaA__AGJ73365

SEQ ID NO: 162473 - RNA, 1701 nt, Artificial Sequence
  derived and/or modified sequence opt4 from hemagglutinin__InfluenzaA__AGJ73367
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggcccuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcguggccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcaggacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162474 - RNA, 1701 nt, Artificial Sequence
  derived and/or modified sequence opt4 from hemagglutinin__InfluenzaA__AGJ73369
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgccgaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162475 - RNA, 1701 nt, Artificial Sequence; identical to SEQ ID NO: 158974
  derived and/or modified sequence opt4 from hemagglutinin__InfluenzaA__AGJ73371

SEQ ID NO: 162476 - RNA, 1701 nt, Artificial Sequence
  derived and/or modified sequence opt4 from hemagglutinin__InfluenzaA__AGJ73373
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccaccccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162477 - RNA, 1701 nt, Artificial Sequence
  derived and/or modified sequence opt4 from hemagglutinin__InfluenzaA__AGJ73375
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccgagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162478 - RNA, 1701 nt, Artificial Sequence
  derived and/or modified sequence opt4 from hemagglutinin__InfluenzaA__AGJ73377
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccagcugccccagagccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucaaccacaagugcgacaacaccugcauggagagcgugaagaacggcaccuacgacuaccccaaguacagcgaggaggccaagcugaacaaggaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162479 - RNA, 1701 nt, Artificial Sequence
  derived and/or modified sequence opt4 from hemagglutinin__InfluenzaA__AGJ73380
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacagcaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcuguucgugcugcuggagaacgagagaacccuggacuaccacgacagcaacgugaaggaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162480 - RNA, 1701 nt, Artificial Sequence
  derived and/or modified sequence opt4 from hemagglutinin__InfluenzaA__AGK62991
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162481 - RNA, 1701 nt, Artificial Sequence
  derived and/or modified sequence opt4 from hemagglutinin__InfluenzaA__AGK62993
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucagcaagugcaacagcgccugcaucaccaccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucauguggagcugccagaagggcaacaucagaugcaacaucugcaucuga

SEQ ID NO: 162482 - RNA, 1701 nt, Artificial Sequence
  derived and/or modified sequence opt4 from hemagglutinin__InfluenzaA__AGK62995
augaagaccaucaucgcccugagcuacauccugugccugguguucgcccagaagcugcccggcaacgacaacagcaccgccacccugugccugggccaccacgccggccccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162483 - RNA, 1701 nt, Artificial Sequence
  derived and/or modified sequence opt4 from hemagglutinin__InfluenzaA__AGK62997
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgacaaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccugcggcgccugcgccagauacgugaagcagaacacccugaagcuggccaccggcaugagaaacgugcccgagaagcagaccagaggcaucuucggcgccaucgccguguucaucgagaacggcugggagggcaugguggacggcugguacggcuucagacaccagaacagcgagggcagagagcaggccgccgccuuccagagcacccaggccgccaucgaccagaucaucggcaagcugaacagacugaucggcgagaccaacgagaaguuccaccagaucgagaaggaguucagcgagguggagagaagaauccaggcccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucauguggagcugccagaagggcaacaucagaugcaacaucugcaucuga

SEQ ID NO: 162484 - RNA, 1701 nt, Artificial Sequence
  derived and/or modified sequence opt4 from hemagglutinin__InfluenzaA__AGK62999
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162485 - RNA, 1701 nt, Artificial Sequence
  derived and/or modified sequence opt4 from hemagglutinin__InfluenzaA__AGK63001
augaagaccaucaucgcccugagcuacauccugugccugguguucgcccagaagcugcccggcaacgacaacagcaccgccacccugugccuggugcaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacggccugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagagagcaggccgccgacuuccagagcacccaggccgccaucgaccagaucaucggcaagcugaacagacugaucggcaagaccaacgagaaguuccaccagaucgagaaggaguucagcgagguggagagaagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucauguggagcugccagaagggcaacaucagaugcaacaucugcaucuga

SEQ ID NO: 162486 - RNA, 1701 nt, Artificial Sequence
  derived and/or modified sequence opt4 from hemagglutinin__InfluenzaA__AGK63003
augaagaccaucaucgcccugagcuacauccugugccugguguucgcccagaagcugcccggcaacgacaacagcaccgccacccugugccugggccaccacgccggccccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucaucgagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162487 - RNA, 1701 nt, Artificial Sequence
  derived and/or modified sequence opt4 from hemagglutinin__InfluenzaA__AGK63005
augaagaccaucaucgcccugagcuacauccugugccugguguucgcccagaagcugcccggcaacgacaacagcaccgccacccugugccuggugcaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacggccugacccaccugaacuucaaguaccccgcccuggacgugaccaugcccaacaacgacaaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccguguucaucgagaacggcugggagggcaugguggacggcugguacggcuucagacaccagaacagcgagggcagagagcaggccgccgacuuccagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162488 - RNA, 1701 nt, Artificial Sequence
  derived and/or modified sequence opt4 from hemagglutinin__InfluenzaA__AGK63007
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162489 - RNA, 1701 nt, Artificial Sequence
  derived and/or modified sequence opt4 from hemagglutinin__InfluenzaA__AGK63009
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggccugcagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162490 - RNA, 1701 nt, Artificial Sequence
  derived and/or modified sequence opt4 from hemagglutinin__InfluenzaA__AGK63011
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162491 - RNA, 1701 nt, Artificial Sequence
  derived and/or modified sequence opt4 from hemagglutinin__InfluenzaA__AGK63013
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccuggacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugcgccagauacgugaagcagaacacccugaagcuggccaccggcaugagaaacgugcccgagaagcagaccagaggcaucuucggcgccaucgccguguucaucgagaacggcugggagggcaugguggacggcugguacggcuucagacaccagaacagcgagggcagaggccaggccgccgcccugcagagcacccaggccgccaucgaccagaucaccggcaagcugaacagacugaucggcgagaccaacgagaaguuccaccagaucgagaaggaguucagcgagguggagggcagaauccaggcccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucauguggagcugccagaagggcaacaucagaugcaacaucugcaucuga

SEQ ID NO: 162492 - RNA, 1701 nt, Artificial Sequence
  derived and/or modified sequence opt4 from hemagglutinin__InfluenzaA__AGK63015
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162493 - RNA, 1701 nt, Artificial Sequence; identical to SEQ ID NO: 159502
  derived and/or modified sequence opt4 from hemagglutinin__InfluenzaA__AGK63017

SEQ ID NO: 162494 - RNA, 1701 nt, Artificial Sequence
  derived and/or modified sequence opt4 from hemagglutinin__InfluenzaA__AGK63019
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162495 - RNA, 1701 nt, Artificial Sequence; identical to SEQ ID NO: 162369
  derived and/or modified sequence opt4 from hemagglutinin__InfluenzaA__AGK63021

SEQ ID NO: 162496 - RNA, 1701 nt, Artificial Sequence
  derived and/or modified sequence opt4 from hemagglutinin__InfluenzaA__AGK63025
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucaucgagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162497 - RNA, 1701 nt, Artificial Sequence; identical to SEQ ID NO: 161594
  derived and/or modified sequence opt4 from hemagglutinin__InfluenzaA__AGK63027

SEQ ID NO: 162498 - RNA, 1701 nt, Artificial Sequence
  derived and/or modified sequence opt4 from hemagglutinin__InfluenzaA__AGK63029
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucaccaccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162499 - RNA, 1701 nt, Artificial Sequence
  derived and/or modified sequence opt4 from hemagglutinin__InfluenzaA__AGK63031
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaagaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaucaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaagcugcaccagaucgagaaggaguucagcgagguggagggcagaauccuggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162500 - RNA, 1701 nt, Artificial Sequence
  derived and/or modified sequence opt4 from hemagglutinin__InfluenzaA__AGK63033
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccugaucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162501 - RNA, 1701 nt, Artificial Sequence
  derived and/or modified sequence opt4 from hemagglutinin__InfluenzaA__AGK63035
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162502 - RNA, 1701 nt, Artificial Sequence
  derived and/or modified sequence opt4 from hemagglutinin__InfluenzaA__AGK63037
augaagaccaucaucgcccugagcuacauccugugccugguguucgcccaggagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcaaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgcccagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162503 - RNA, 1701 nt, Artificial Sequence
  derived and/or modified sequence opt4 from hemagglutinin__InfluenzaA__AGK63039
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaagaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugacccugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucagcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucauguggagcugccagaagggcaacaucagaugcaacaucugcaucuga

SEQ ID NO: 162504 - RNA, 1701 nt, Artificial Sequence
  derived and/or modified sequence opt4 from hemagglutinin__InfluenzaA__AGK63041
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggccugcagaacaagaagugggaccugaucguggagagaagcaaggcccacagcuacugcuaccccuacgacgugcccgacuacgccagccugagaagccugguggccagcagcggcacccuggaguucaacaacgagagcuucaacuggaccgaggugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162505 - RNA, 1701 nt, Artificial Sequence
  derived and/or modified sequence opt4 from hemagglutinin__InfluenzaA__AGK63043
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162506 - RNA, 1701 nt, Artificial Sequence
  derived and/or modified sequence opt4 from hemagglutinin__InfluenzaA__AGK63045
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaagaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgcccagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162507 - RNA, 1701 nt, Artificial Sequence
  derived and/or modified sequence opt4 from hemagglutinin__InfluenzaA__AGK63047
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagacagagagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccgccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162508 - RNA, 1683 nt, Artificial Sequence
  derived and/or modified sequence opt4 from hemagglutinin__InfluenzaA__AGK82158
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgccaccagcgccugcagaagaagcggcagcagcuucuacgccgagaugaaguggcugcugagcaacaccgacaacgccgccuucccccagaugaccaagagcuacaagaacaccagaaagagccccgcccugaucguguggggcauccaccacagcgugagcaccgccgagcagaccaagcuguacggcagcggcaacaagcuggugaccgugggcagcagcaacuaccagcagagcuucgugcccagccccggcgccagaccccaggugaacggccugagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagagccgugggcaagugccccagauacgugaagcagagaagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaacgagguggagaagcagaucggcaacgugaucaacuggaccagagacagcaucaccgagguguggagcuacaacgccgagcugcugguggccauggagaaccagcacaccaucgaccuggccgacagcgagauggacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgugaugggccugguguucaucugcgugaagaacggcaacaugagaugcaccaucugcaucuga

SEQ ID NO: 162509 - RNA, 1683 nt, Artificial Sequence
  derived and/or modified sequence opt4 from hemagglutinin__InfluenzaA__AGK84857
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgccaccagcgccugcagaagaagcggcagcagcuucuacgccgagaugaaguggcugcugagcaacaccgacaacgccgccuucccccagaucaccaagagcuacaagaacaccagaaagagccccgcccugaucguguggggcauccaccacagcgugagcaccgccgagcagaccaagcuguacggcagcggcaacaagcuggugaccgugggcagcagcaacuaccagcagagcuucgugcccagccccggcgccagaccccaggugaacggccugagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagagccgugggcaagugccccagauacgugaagcagagaagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaacgagguggagaagcagaucggcaacgugaucaacuggaccagagacagcaucaccgagguguggagcuacaacgccgagcugcugguggccauggagaaccagcacaccaucgaccuggccgacagcgagauggacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgugaugggccugguguucaucugcgugaagaacggcaacaugagaugcaccaucugcaucuga

SEQ ID NO: 162510 - RNA, 1683 nt, Artificial Sequence
  derived and/or modified sequence opt4 from hemagglutinin__InfluenzaA__AGK84860
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagaugaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgccaccagcgccugcagaagaagcggcagcagcuucuacgccgagaugaaguggcugcugagcaacaccgacaacgccgccuucccccagaugaccaagagcuacaagaacaccagaaagagccccgcccugaucguguggggcauccaccacagcgugagcaccgccgagcagaccaagcuguacggcagcggcaacaagcuggugaccgugggcagcagcaacuaccagcagagcuucgugcccagccccggcgccagaccccaggugaacggccugagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagagccgugggcaagugccccagauacgugaagcagagaagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaacgagguggagaagcagaucggcaacgugaucaacuggaccagagacagcaucaccgagguguggagcuacaacgccgagcugcugguggccauggagaaccagcacaccaucgaccuggccgacagcgagauggacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgugaugggccugguguucaucugcgugaagaacggcaacaugagaugcaccaucugcaucuga

SEQ ID NO: 162511 - RNA, 1683 nt, Artificial Sequence
  derived and/or modified sequence opt4 from hemagglutinin__InfluenzaA__AGK84863
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagaagaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgccaccagcgccugcagaagaagcggcagcagcuucuacgccgagaugaaguggcugcugagcaacaccgacaacgccgccuucccccagaugaccaagagcuacaagaacaccagaaagagccccgcccugaucguguggggcauccaccacagcgugagcaccgccgagcagaccaagcuguacggcagcggcaacaagcuggugaccgugggcagcagcaacuaccagcagagcuucgugcccagccccggcgccagaccccaggugaacggccugagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagagccgugggcaagugccccagauacgugaagcagagaagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaacgagguggagaagcagaucggcaacgugaucaacuggaccagagacagcaucaccgagguguggagcuacaacgccgagcugcugguggccauggagaaccagcacaccaucgaccuggccgacagcgagauggacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgugaugggccugguguucaucugcgugaagaacggcaacaugagaugcaccaucugcaucuga

SEQ ID NO: 162512 - RNA, 1701 nt, Artificial Sequence
  derived and/or modified sequence opt4 from hemagglutinin__InfluenzaA__AGL07713
augaaggccauccugguggugcugcuguacaccuucgccaccgccaacgccgacacccugugcaucggcuaccacgccaacaacagcaccgacaccguggacaccgugcuggagaagaacgugaccgugaccagaagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccggcagcuggcccaaccacgacagcaacaagggcgugaccgccgccugcccccacgccggcgccaagggcuucuacaagaaccugaucuggcugguggagaagggcaacagcuaccccaagcugagcaagagcuacaucaacgacaagggcaaggaggugcuggugcuguggggcauccaccaccccagcaccaccgccgaccagcagagacuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162513 - RNA, 1701 nt, Artificial Sequence
  derived and/or modified sequence opt4 from hemagglutinin__InfluenzaA__AGL09731
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162514 - RNA, 1701 nt, Artificial Sequence
  derived and/or modified sequence opt4 from hemagglutinin__InfluenzaA__AGL09732
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162515 - RNA, 1701 nt, Artificial Sequence
  derived and/or modified sequence opt4 from hemagglutinin__InfluenzaA__AGL09734
augaagaccaucaucgcccugagcuacauccugugccugguguucgcccagaaguuccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucaucgagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162516 - RNA, 1701 nt, Artificial Sequence
  derived and/or modified sequence opt4 from hemagglutinin__InfluenzaA__AGL09735
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucagcaucuga

SEQ ID NO: 162517 - RNA, 1701 nt, Artificial Sequence
  derived and/or modified sequence opt4 from hemagglutinin__InfluenzaA__AGL09736
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162518 - RNA, 1701 nt, Artificial Sequence; identical to SEQ ID NO: 162403
  derived and/or modified sequence opt4 from hemagglutinin__InfluenzaA__AGL09737

SEQ ID NO: 162519 - RNA, 1701 nt, Artificial Sequence
  derived and/or modified sequence opt4 from hemagglutinin__InfluenzaA__AGL09739
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcagcugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162520 - RNA, 1701 nt, Artificial Sequence; identical to SEQ ID NO: 162355
  derived and/or modified sequence opt4 from hemagglutinin__InfluenzaA__AGL09740

SEQ ID NO: 162521 - RNA, 1701 nt, Artificial Sequence; identical to SEQ ID NO: 161594
  derived and/or modified sequence opt4 from hemagglutinin__InfluenzaA__AGL09741

SEQ ID NO: 162522 - RNA, 1701 nt, Artificial Sequence
  derived and/or modified sequence opt4 from hemagglutinin__InfluenzaA__AGL09742
augaagaccaucaucgcccugagcuacauccugugccugguguucgcccaggagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagacccagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugagaagcggcuacaaggacuggauccuguggaucagcuucgccaucagcugcuuccugcugugcguggcccugcugggcuucaucaugugggccugccagaagggcaacaucagaugcagcaucugcaucuga

SEQ ID NO: 162523 - RNA, 1701 nt, Artificial Sequence; identical to SEQ ID NO: 162378
  derived and/or modified sequence opt4 from hemagglutinin__InfluenzaA__AGL09744

SEQ ID NO: 162524 - RNA, 1701 nt, Artificial Sequence
  derived and/or modified sequence opt4 from hemagglutinin__InfluenzaA__AGL09745
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacgugggcaacggcugcuucaagaucuaccacaagugcgacaacaccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162525 - RNA, 1701 nt, Artificial Sequence; identical to SEQ ID NO: 162517
  derived and/or modified sequence opt4 from hemagglutinin__InfluenzaA__AGL09746

SEQ ID NO: 162526 - RNA, 1701 nt, Artificial Sequence; identical to SEQ ID NO: 162355
  derived and/or modified sequence opt4 from hemagglutinin__InfluenzaA__AGL09747

SEQ ID NO: 162527 - RNA, 1701 nt, Artificial Sequence; identical to SEQ ID NO: 162378
  derived and/or modified sequence opt4 from hemagglutinin__InfluenzaA__AGL09748

SEQ ID NO: 162528 - RNA, 1701 nt, Artificial Sequence; identical to SEQ ID NO: 162376
  derived and/or modified sequence opt4 from hemagglutinin__InfluenzaA__AGL09749

SEQ ID NO: 162529 - RNA, 1701 nt, Artificial Sequence; identical to SEQ ID NO: 162514
  derived and/or modified sequence opt4 from hemagglutinin__InfluenzaA__AGL09750

SEQ ID NO: 162530 - RNA, 1701 nt, Artificial Sequence; identical to SEQ ID NO: 162355
  derived and/or modified sequence opt4 from hemagglutinin__InfluenzaA__AGL09751

SEQ ID NO: 162531 - RNA, 1701 nt, Artificial Sequence; identical to SEQ ID NO: 162514
  derived and/or modified sequence opt4 from hemagglutinin__InfluenzaA__AGL09753

SEQ ID NO: 162532 - RNA, 1701 nt, Artificial Sequence
  derived and/or modified sequence opt4 from hemagglutinin__InfluenzaA__AGL09754
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugccugcugcugugcguggcccugcugggcuucaucaugugggccugccagaagggcaacaucagaugcaacaucugcaucuga

SEQ ID NO: 162533 - RNA, 1701 nt, Artificial Sequence; identical to SEQ ID NO: 162517
  derived and/or modified sequence opt4 from hemagglutinin__InfluenzaA__AGL09756

SEQ ID NO: 162534 - RNA, 1701 nt, Artificial Sequence
  derived and/or modified sequence opt4 from hemagglutinin__InfluenzaA__AGL09758
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagaucugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaacagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacaccaccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaugugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162535 - RNA, 1701 nt, Artificial Sequence
  derived and/or modified sequence opt4 from hemagglutinin__InfluenzaA__AGL09760
augaagaccaucaucgccgugagcuacauccugugccugguguucgcccaggagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162536 - RNA, 1701 nt, Artificial Sequence; identical to SEQ ID NO: 162388
  derived and/or modified sequence opt4 from hemagglutinin__InfluenzaA__AGL09761

SEQ ID NO: 162537 - RNA, 1701 nt, Artificial Sequence
  derived and/or modified sequence opt4 from hemagglutinin__InfluenzaA__AGL09762
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162538 - RNA, 1701 nt, Artificial Sequence; identical to SEQ ID NO: 162514
  derived and/or modified sequence opt4 from hemagglutinin__InfluenzaA__AGL09763

SEQ ID NO: 162539 - RNA, 1701 nt, Artificial Sequence
  derived and/or modified sequence opt4 from hemagglutinin__InfluenzaA__AGL09764
augaagaccaucaucgcccugagcuacauccugugccugguguucgcccagaagauccccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162540 - RNA, 1701 nt, Artificial Sequence; identical to SEQ ID NO: 162378
  derived and/or modified sequence opt4 from hemagglutinin__InfluenzaA__AGL09765

SEQ ID NO: 162541 - RNA, 1701 nt, Artificial Sequence
  derived and/or modified sequence opt4 from hemagglutinin__InfluenzaA__AGL09766
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagauccugagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162542 - RNA, 1701 nt, Artificial Sequence
  derived and/or modified sequence opt4 from hemagglutinin__InfluenzaA__AGL09767
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162543 - RNA, 1701 nt, Artificial Sequence
  derived and/or modified sequence opt4 from hemagglutinin__InfluenzaA__AGL09769
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162544 - RNA, 1701 nt, Artificial Sequence; identical to SEQ ID NO: 162378
  derived and/or modified sequence opt4 from hemagglutinin__InfluenzaA__AGL09770

SEQ ID NO: 162545 - RNA, 1701 nt, Artificial Sequence
  derived and/or modified sequence opt4 from hemagglutinin__InfluenzaA__AGL09771
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacaucuacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162546 - RNA, 1701 nt, Artificial Sequence
  derived and/or modified sequence opt4 from hemagglutinin__InfluenzaA__AGL09772
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacuacguguacagagacgaggcccugaacaacagauuccagaucaagggcguggagcugaagagcggcuacaaggacuggauccuguggaucagcuucgccaccagcugcuuccugcugugcguggcccugcugggcuucaucaugugggccugccagaagggcaacaucagaugcaacaucugcaucuga

SEQ ID NO: 162547 - RNA, 1701 nt, Artificial Sequence
  derived and/or modified sequence opt4 from hemagglutinin__InfluenzaA__AGL09773
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccgaggugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacuacguguacagagacgaggcccugaacaacagauuccagaucaagggcguggagcugaagagcggcuacaaggacuggauccuguggaucagcuucgccaccagcugcuuccugcugugcguggcccugcugggcuucaucaugugggccugccagaagggcaacaucagaugcaacaucugcaucuga

SEQ ID NO: 162548 - RNA, 1701 nt, Artificial Sequence; identical to SEQ ID NO: 162546
  derived and/or modified sequence opt4 from hemagglutinin__InfluenzaA__AGL09774

SEQ ID NO: 162549 - RNA, 1701 nt, Artificial Sequence; identical to SEQ ID NO: 162388
  derived and/or modified sequence opt4 from hemagglutinin__InfluenzaA__AGL09775

SEQ ID NO: 162550 - RNA, 1701 nt, Artificial Sequence; identical to SEQ ID NO: 162546
  derived and/or modified sequence opt4 from hemagglutinin__InfluenzaA__AGL09776

SEQ ID NO: 162551 - RNA, 1701 nt, Artificial Sequence; identical to SEQ ID NO: 162546
  derived and/or modified sequence opt4 from hemagglutinin__InfluenzaA__AGL09777

SEQ ID NO: 162552 - RNA, 1701 nt, Artificial Sequence
  derived and/or modified sequence opt4 from hemagglutinin__InfluenzaA__AGL09778
augaagaccaucaucgcccugagcuacauccugugccugaucuucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162553 - RNA, 1701 nt, Artificial Sequence
  derived and/or modified sequence opt4 from hemagglutinin__InfluenzaA__AGL09779
augaagaccaucaucgcccugagcuacauccugugccugguguucgcccagaagcugcccggcaacaacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162554 - RNA, 1701 nt, Artificial Sequence
  derived and/or modified sequence opt4 from hemagglutinin__InfluenzaA__AGL09780
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucgacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucagccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162555 - RNA, 1701 nt, Artificial Sequence; identical to SEQ ID NO: 162513
  derived and/or modified sequence opt4 from hemagglutinin__InfluenzaA__AGL09781

SEQ ID NO: 162556 - RNA, 1701 nt, Artificial Sequence; identical to SEQ ID NO: 162378
  derived and/or modified sequence opt4 from hemagglutinin__InfluenzaA__AGL09782

SEQ ID NO: 162557 - RNA, 1701 nt, Artificial Sequence
  derived and/or modified sequence opt4 from hemagglutinin__InfluenzaA__AGL09783
augaagaccaucaucgcccugagcuacauccugugccugguguucgcccagaagcugcccggcaacgacaacagcaccgccacccugugccugggccaccacgccgugcccaacggcaccguggugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaacccagaaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 162558 - RNA, 1701 nt, Artificial Sequence; identical to SEQ ID NO: 162388
  derived and/or modified sequence opt4 from hemagglutinin__InfluenzaA__AGL09785

SEQ ID NO: 162559 - RNA, 1701 nt, Artificial Sequence
  derived and/or modified sequence opt4 from hemagglutinin__InfluenzaA__AGL09786
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucgacaacgagagcuucaacugggccggcgugacccagaacggcaccagcagcgccugcaucagaggcagcaagagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucagccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162560 - RNA, 1701 nt, Artificial Sequence
  derived and/or modified sequence opt4 from hemagglutinin__InfluenzaA__AGL09787
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162561 - RNA, 1701 nt, Artificial Sequence; identical to SEQ ID NO: 162560
  derived and/or modified sequence opt4 from hemagglutinin__InfluenzaA__AGL09788

SEQ ID NO: 162562 - RNA, 1701 nt, Artificial Sequence; identical to SEQ ID NO: 162560
  derived and/or modified sequence opt4 from hemagglutinin__InfluenzaA__AGL09789

SEQ ID NO: 162563 - RNA, 1701 nt, Artificial Sequence; identical to SEQ ID NO: 162514
  derived and/or modified sequence opt4 from hemagglutinin__InfluenzaA__AGL09790

SEQ ID NO: 162564 - RNA, 1701 nt, Artificial Sequence
  derived and/or modified sequence opt4 from hemagglutinin__InfluenzaA__AGL09791
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacaugaccaugcccaacaacgagcaguucgacaagcuguacaucuggggcgugcaccaccccggcaccgacaaggaccagaucagccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162565 - RNA, 1701 nt, Artificial Sequence; identical to SEQ ID NO: 162514
  derived and/or modified sequence opt4 from hemagglutinin__InfluenzaA__AGL09792

SEQ ID NO: 162566 - RNA, 1701 nt, Artificial Sequence
  derived and/or modified sequence opt4 from hemagglutinin__InfluenzaA__AGL09794
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacacccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162567 - RNA, 1701 nt, Artificial Sequence; identical to SEQ ID NO: 162514
  derived and/or modified sequence opt4 from hemagglutinin__InfluenzaA__AGL09795

SEQ ID NO: 162568 - RNA, 1701 nt, Artificial Sequence
  derived and/or modified sequence opt4 from hemagglutinin__InfluenzaA__AGL09797
augaagaccaucaucgcccugagcuacauccugugccugguguucagccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162569 - RNA, 1701 nt, Artificial Sequence
  derived and/or modified sequence opt4 from hemagglutinin__InfluenzaA__AGL09798
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacuucgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacuacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162570 - RNA, 1701 nt, Artificial Sequence; identical to SEQ ID NO: 162568
  derived and/or modified sequence opt4 from hemagglutinin__InfluenzaA__AGL09799

SEQ ID NO: 162571 - RNA, 1701 nt, Artificial Sequence; identical to SEQ ID NO: 162514
  derived and/or modified sequence opt4 from hemagglutinin__InfluenzaA__AGL09800

SEQ ID NO: 162572 - RNA, 1701 nt, Artificial Sequence; identical to SEQ ID NO: 162378
  derived and/or modified sequence opt4 from hemagglutinin__InfluenzaA__AGL09801

SEQ ID NO: 162573 - RNA, 1701 nt, Artificial Sequence; identical to SEQ ID NO: 162378
  derived and/or modified sequence opt4 from hemagglutinin__InfluenzaA__AGL09802

SEQ ID NO: 162574 - RNA, 1701 nt, Artificial Sequence
  derived and/or modified sequence opt4 from hemagglutinin__InfluenzaA__AGL09803
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagaacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162575 - RNA, 1701 nt, Artificial Sequence; identical to SEQ ID NO: 162411
  derived and/or modified sequence opt4 from hemagglutinin__InfluenzaA__AGL09804

SEQ ID NO: 162576 - RNA, 1701 nt, Artificial Sequence; identical to SEQ ID NO: 162517
  derived and/or modified sequence opt4 from hemagglutinin__InfluenzaA__AGL09805

SEQ ID NO: 162577 - RNA, 1701 nt, Artificial Sequence; identical to SEQ ID NO: 162546
  derived and/or modified sequence opt4 from hemagglutinin__InfluenzaA__AGL09806

SEQ ID NO: 162578 - RNA, 1701 nt, Artificial Sequence; identical to SEQ ID NO: 162517
  derived and/or modified sequence opt4 from hemagglutinin__InfluenzaA__AGL09807

SEQ ID NO: 162579 - RNA, 1701 nt, Artificial Sequence
  derived and/or modified sequence opt4 from hemagglutinin__InfluenzaA__AGL09808
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacgugggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162580 - RNA, 1701 nt, Artificial Sequence
  derived and/or modified sequence opt4 from hemagglutinin__InfluenzaA__AGL09809
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcggcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaucagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 162581 - RNA, 1701 nt, Artificial Sequence
  derived and/or modified sequence opt4 from hemagglutinin__InfluenzaA__AGL09810
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucagcaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcaccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaugggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162582 - RNA, 1701 nt, Artificial Sequence; identical to SEQ ID NO: 162378
  derived and/or modified sequence opt4 from hemagglutinin__InfluenzaA__AGL09811

SEQ ID NO: 162583 - RNA, 1701 nt, Artificial Sequence
  derived and/or modified sequence opt4 from hemagglutinin__InfluenzaA__AGL09812
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccaggacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162584 - RNA, 1701 nt, Artificial Sequence; identical to SEQ ID NO: 162355
  derived and/or modified sequence opt4 from hemagglutinin__InfluenzaA__AGL09813

SEQ ID NO: 162585 - RNA, 1701 nt, Artificial Sequence; identical to SEQ ID NO: 162403
  derived and/or modified sequence opt4 from hemagglutinin__InfluenzaA__AGL09814

SEQ ID NO: 162586 - RNA, 1701 nt, Artificial Sequence
  derived and/or modified sequence opt4 from hemagglutinin__InfluenzaA__AGL09815
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaagcauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162587 - RNA, 1701 nt, Artificial Sequence; identical to SEQ ID NO: 162403
  derived and/or modified sequence opt4 from hemagglutinin__InfluenzaA__AGL09816

SEQ ID NO: 162588 - RNA, 1701 nt, Artificial Sequence
  derived and/or modified sequence opt4 from hemagglutinin__InfluenzaA__AGL09817
augaagaccaucaucgcccugagcuacauccugugccugguguucgcccaggagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacagcgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162589 - RNA, 1701 nt, Artificial Sequence; identical to SEQ ID NO: 162403
  derived and/or modified sequence opt4 from hemagglutinin__InfluenzaA__AGL09818

SEQ ID NO: 162590 - RNA, 1701 nt, Artificial Sequence; identical to SEQ ID NO: 162514
  derived and/or modified sequence opt4 from hemagglutinin__InfluenzaA__AGL09819

SEQ ID NO: 162591 - RNA, 1701 nt, Artificial Sequence
  derived and/or modified sequence opt4 from hemagglutinin__InfluenzaA__AGL09820
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagaucgagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162592 - RNA, 1701 nt, Artificial Sequence
  derived and/or modified sequence opt4 from hemagglutinin__InfluenzaA__AGL09821
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcaucgagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162593 - RNA, 1701 nt, Artificial Sequence; identical to SEQ ID NO: 162517
  derived and/or modified sequence opt4 from hemagglutinin__InfluenzaA__AGL09822

SEQ ID NO: 162594 - RNA, 1701 nt, Artificial Sequence; identical to SEQ ID NO: 162560
  derived and/or modified sequence opt4 from hemagglutinin__InfluenzaA__AGL09823

SEQ ID NO: 162595 - RNA, 1701 nt, Artificial Sequence
  derived and/or modified sequence opt4 from hemagglutinin__InfluenzaA__AGL09824
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcaccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162596 - RNA, 1701 nt, Artificial Sequence; identical to SEQ ID NO: 162514
  derived and/or modified sequence opt4 from hemagglutinin__InfluenzaA__AGL09825

SEQ ID NO: 162597 - RNA, 1701 nt, Artificial Sequence; identical to SEQ ID NO: 162595
  derived and/or modified sequence opt4 from hemagglutinin__InfluenzaA__AGL09826

SEQ ID NO: 162598 - RNA, 1701 nt, Artificial Sequence; identical to SEQ ID NO: 162388
  derived and/or modified sequence opt4 from hemagglutinin__InfluenzaA__AGL09827

SEQ ID NO: 162599 - RNA, 1701 nt, Artificial Sequence
  derived and/or modified sequence opt4 from hemagglutinin__InfluenzaA__AGL09828
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuacagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162600 - RNA, 1701 nt, Artificial Sequence
  derived and/or modified sequence opt4 from hemagglutinin__InfluenzaA__AGL09829
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccuggagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162601 - RNA, 1701 nt, Artificial Sequence; identical to SEQ ID NO: 162403
  derived and/or modified sequence opt4 from hemagglutinin__InfluenzaA__AGL09830

SEQ ID NO: 162602 - RNA, 1701 nt, Artificial Sequence; identical to SEQ ID NO: 162513
  derived and/or modified sequence opt4 from hemagglutinin__InfluenzaA__AGL09831

SEQ ID NO: 162603 - RNA, 1701 nt, Artificial Sequence
  derived and/or modified sequence opt4 from hemagglutinin__InfluenzaA__AGL09832
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcaccaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162604 - RNA, 1701 nt, Artificial Sequence; identical to SEQ ID NO: 162514
  derived and/or modified sequence opt4 from hemagglutinin__InfluenzaA__AGL09833

SEQ ID NO: 162605 - RNA, 1701 nt, Artificial Sequence
  derived and/or modified sequence opt4 from hemagglutinin__InfluenzaA__AGL09881
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcgccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162606 - RNA, 1701 nt, Artificial Sequence; identical to SEQ ID NO: 162378
  derived and/or modified sequence opt4 from hemagglutinin__InfluenzaA__AGL09882

SEQ ID NO: 162607 - RNA, 1701 nt, Artificial Sequence; identical to SEQ ID NO: 162355
  derived and/or modified sequence opt4 from hemagglutinin__InfluenzaA__AGL09883

SEQ ID NO: 162608 - RNA, 1701 nt, Artificial Sequence; identical to SEQ ID NO: 162355
  derived and/or modified sequence opt4 from hemagglutinin__InfluenzaA__AGL09884

SEQ ID NO: 162609 - RNA, 1683 nt, Artificial Sequence; identical to SEQ ID NO: 162508
  derived and/or modified sequence opt4 from hemagglutinin__InfluenzaA__AGL44438

SEQ ID NO: 162610 - RNA, 1701 nt, Artificial Sequence
  derived and/or modified sequence opt4 from hemagglutinin__InfluenzaA__AGN69267
augaaggccauccugguggugcugcuguacaccuucaccaccggcaacgccgacacccugugcaucggcuaccacgccaacaacagcaccgacaccguggacaccgugcuggagaagaacgugaccgugacccacagcgugaaccugcuggaggacagacacaacggcaagcugugcaagcugagaggcguggccccccugcaccugggcaagugcaacaucgccggcuggcugcugggcaaccccgagugcgagcugcuguucaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaaggccagcagcuggcccaaccacgagaccaacagaggcgugaccgccgccugccccuacgccggcgccaacagcuucuacagaaaccugaucuggcuggugaagaagggcaacagcuaccccaagcugagcaagagcuacaucaacaacaaggagaaggaggugcuggugcuguggggcauccaccacccccccaccagcaccgaccagcagagccuguaccagaacgccgacgccuacguguucgugggcagcagcaaguacagcaagaaguucaagcccgagaucgccaccagacccaaggugagaggccaggccggcagaaugaacuacuacuggacccugguggagcccggcgacaccaucaccuucgaggccaccggcaaccugguggugcccagauacgccuucgccaugaagagaggcagcggcagcggcaucaucaucagcgacacccccgugcacgacugcaacaccaccugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacagaaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggccugcuggacguguggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugcuggugagccugggcgccaucagcuucuggaugugcagcaacggcagccugcagugcagaaucugcaucuga

SEQ ID NO: 162611 - RNA, 1701 nt, Artificial Sequence
  derived and/or modified sequence opt4 from hemagglutinin__InfluenzaA__AGN69278
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacagacacaacggcaagcugugcaagcugagaggcguggccccccugcaccugggcaagugcaacaucgccggcuggcugcugggcaaccccgagugcgagcugcuguucaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaaggccagcagcuggcccaaccacgagcccaacagaggcgugaccgccgccugccccuacgccggcgccaacagcuucuacagaaaccugaucuggcuggugaagaagggcaacagcuaccccaagcugagcaagagcuacaucaacaacaaggagaaggaggugcuggugcuguggggcauccaccacccccccaccagcaccgaccagcagagccuguaccagaacgccgacgccuacguguucgugggcagcagcaaguacaacaagaaguucaagcccgagaucgccaccagacccaaggugagaggccaggccggcagaaugaacuacuacuggacccugguggagcccggcgacaccaucaccuucgaggccaccggcaaccugguggugcccagauacgccuucgccaugaagagaggcagcggcagcggcaucaucaucagcgacacccccgugcacgacugcaacaccaccugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacagaaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggccugcuggacguguggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugcuggugagccugggcgccaucagcuucuggaugugcagcaacggcagccugcagugcagaaucugcaucuga

SEQ ID NO: 162612 - RNA, 1701 nt, Artificial Sequence
  derived and/or modified sequence opt4 from hemagglutinin__InfluenzaA__AGN69302
auggaggccaagcuguucgugcuguucugcgccuucaccgcccugaaggccgacaccaucugcgugggcuaccacgccaacaacagcaccgacaccguggacaccauccuggagaagaacgugaccgugacccacagcgugaaccugcuggagaacagccacaacggcaagcugugcagccugaacggcaagaucccccugcagcugggcaacugcaacguggccggcuggauccugggcaaccccaagugcgaccugcugcugaccgccaacagcuggagcuacaucaucgagaccagcaacagcaaggacggcgccugcuaccccggcgaguucgccgacuacgaggagcugaaggagcagcugagcaccgugagcagcuucgagagauucgagaucuuccccaaggccaccagcuggcccaaccacgacaccaccagaggcaccaccguggccugcagccacagcggcgccaacagcuucuacagaaaccugcuguggaucgugaagaagggcaacagcuaccccaagcugagcaagagcuacaccaacaacaagggcaaggaggugcuggugaucuggggcgugcaccacccccccaccgacagcgaccagcagacccuguaccagaacaaccacaccuacgugagcgugggcagcagcaaguacuacaagagauucacccccgagaucguggccagacccaaggugagagagcaggccggcagaaugaacuacuacuggacccugcuggaccagggcgacaccaucaccuucgaggccaccggcaaccugaucgcccccuggcacgccuucgcccugaagaagggcagcagcagcggcaucaugaugagcgacgcccaggugcacaacugcaccaccaagugccagaccccccacggcgcccugaagggcaaccugcccuuccagaacgugcaccccgugaccaucggcgagugccccaaguacgugaagagcacccagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaucgccaucgacggcaucagcaacaaggugaacagcgugaucgagaagaugaacauccaguucaccagcgugggcaaggaguucaacagccuggagaagagaauggagaaccugaacaagaagguggacgacggcuuccuggacguguggaccuacaacgccgagcugcugauccugcuggagaacgagagaacccuggacuuccacgaccugaacgugaagaaccuguacgagaaggugaagagccagcugagaaacaacgccaaggagaucggcaacggcugcuucgaguucuaccacaagugcgacaacgagugcauggagagcgugaagaacggcaccuacaacuaccccaaguacagcgaggagagcaagcugaacagagaggagaucgacggcgugaagcuggagagcaugggcauccaccagauccuggccaucuacagcaccguggccagcagccuggugcugcuggugagccugggcgccaucagcuucuggaugugcagcaacggcagccugcagugcagagugugcaucuga

SEQ ID NO: 162613 - RNA, 1701 nt, Artificial Sequence; identical to SEQ ID NO: 162612
  derived and/or modified sequence opt4 from hemagglutinin__InfluenzaA__AGN69314

SEQ ID NO: 162614 - RNA, 1701 nt, Artificial Sequence; identical to SEQ ID NO: 162612
  derived and/or modified sequence opt4 from hemagglutinin__InfluenzaA__AGN69326

SEQ ID NO: 162615 - RNA, 1701 nt, Artificial Sequence
  derived and/or modified sequence opt4 from hemagglutinin__InfluenzaA__AGN69338
auggaggccaagcuguucgugcuguucugcgccuucaccgcccugaaggccgacaccaucugcgugggcuaccacgccaacaacagcaccgacaccguggacaccauccuggagaagaacgugaccgugacccacagcgugaaccugcuggagaacagccacaacggcaagcugugcagccugaacggcaagaucccccugcagcugggcaacugcaacguggccggcuggauccugggcaaccccaagugcgaccugcugcugaccgccaacagcuggagcuacaucaucgagaccagcaacagcaagaacggcgccugcuaccccggcgaguucgccgacuacgaggagcugaaggagcagcugagcaccgugagcagcuucgagagauucgagaucuuccccaaggccaccagcuggcccaaccacgacaccaccagaggcaccaccguggccugcagccacagcggcgccaacagcuucuacagaaaccugcuguggaucgugaagaagggcaacagcuaccccaagcugagcaagagcuacaccaacaacaagggcaaggaggugcuggugaucuggggcgugcaccacccccccaccgacagcgaccagcagacccuguaccagaacaaccacaccuacgugagcgugggcagcagcaaguacuacaagagauucacccccgagaucguggccagacccaaggugagagagcaggccggcagaaugaacuacuacuggacccugcugcaccagggcgacaccaucaccuucgaggccaccggcaaccugaucgcccccuggcacgccuucgcccugaacgagggcagcagcagcggcaucaugagaagcgacgcccaggugcacaacugcaccaccaagugccagaccccccacggcgcccugaagggcaaccugcccuuccagaacgugcaccccgugaccaucggcgagugccccaaguacgugaagagcacccagcugagaauggccaccggccugagaaacauccccagcauccagagcagaggccuguucggcgccaucgccggcuucaucgagggcggcuggaccggcaugguggacggcugguacggcuaccaccacagaaacgagcagggcagcggcuacgccgccgaccagaagagcacccagaucgccaucgacggcaucagcaacaaggugaacagcgugaucgagaagaugaacauccaguucaccagcgugggcaaggagugcaacagccuggagaagagaauggagaaccugaacaagaagguggacgacggcuuccuggacguguggaccuacaacgccgagcugcugauccugcuggagaacgagagaacccuggacuuccacgaccugaacgugaagaaccuguacgagaaggugaagagccagcugagaaacaacgccaaggagaucggcaacggcugcuucgaguucuaccacaagugcgacaacgagugcauggagagcgugaagaacggcaccuacaacuaccccaaguacagcgaggagagcaagcugaacagagaggagaucgacggcgugaagcuggagagcaugggcauccaccagauccuggccaucuacagcaccguggccagcagccuggugcugcuggugagccugggcgccaucagcuucuggaugugcagcaacggcagccugcagugcagagugugcaucuga

SEQ ID NO: 162616 - RNA, 1701 nt, Artificial Sequence
  derived and/or modified sequence opt4 from hemagglutinin__InfluenzaA__AGO00265
augaaggccagacugcuggugcugcugugcgccaucgccgccaccgacgccgacaccaucugcaucggcuaccacgccaacaacagcaccgacaccguggacaccauccuggagaagaacgugaccgugacccacagcgugaaccugcuggaggacagccacaacggcaagcugugcagacugaagggcaucgccccccugcagcugggcaagugcaacaucgccggcuggauccugggcaaccccgagugcgagagccugcugagcgagagaagcuggagcuacaucguggagacccccaacagcgagaacggcaccugcuaccccggcgacuucaucgacuacgaggagcugagagagcagcugagcagcgugaccagcuucgagagauucgagaucuuccccaaggagaccagcuggcccaagcacaacaccaccaagggcgugaccgccgccugcagccacgccggcaagugcagcuucuacagaaaccugcuguggcugaccgagaaggacggcagcuaccccaaccugaacaacagcuacgugaacaagaagggcaaggaggugcuggugcuguggggcgugcaccaccccagcaacaucaaggaccagcagacccuguaccagaaggagaacgccuacgugagcguggugagcagcaacuacaacagaagauucacccccgagaucgccgagagacccaaggugagaggccaggccggcagaaugaacuacuacuggacccugcuggagcccggcgacaccaucaucuucgaggccaacggcaaccugaucgcccccugguacgccuucgcccugagcagaggcuucggcagcggcaucaucaccagcaacgccagcaugcacgagugcaacaccaagugccagaccccccagggcgccaucaacagcagccugcccuuccagaacauccaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaaccuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugagaaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162617 - RNA, 1701 nt, Artificial Sequence
  derived and/or modified sequence opt4 from hemagglutinin__InfluenzaA__AGO00277
augaaggccaagcugcugauccugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggauccugggcaaccccgagugcgagagccugcugagcaagagaagcuggagcuacaucgccgagacccccaacagcgagaacggcaccugcuaccccggcgacuucgccgacuacgaggagcugagagagcagcugagcagcgugagcagcuucgagagauucgagaucuuccccaaggagagaagcuggcccaaccacaacaucaacaucggcgugaccgccgccugcagccacgccggcaagagcagcuucuacaagaaccugcuguggcugaccgagaaggacggcagcuaccccaaccugaacaagagcuacgugaacaagaaggagaaggaggugcuggugcuguggggcgugcaccaccccagcaacaucgagaaccagaagacccuguacagaaaggagaacgccuacgugagcguggugagcagcaacuacaacagaagauucacccccgagaucgccgagagacccaaggugagaggccaggccggcagaaugaacuacuacuggacccugcuggagcccggcgacaccaucaucuucgaggccaacggcaaccugaucgcccccugguacgccuucgcccugagcagaggccugggcagcggcaucaucaccagcaacgccagcauggacgagugcgacaccaagugccagaccccccagggcgccaucaacagcagccugcccuuccagaacauccaccccuucaccaucggcgagugccccaaguacgugagaagcaccaagcugagaauggugaccggccugagaaacauccccagcauccagagcagaggccuguucggcgccaucgccggcuucaucgagggcggcugggccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugagaaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162618 - RNA, 1701 nt, Artificial Sequence; identical to SEQ ID NO: 154154
  derived and/or modified sequence opt4 from hemagglutinin__InfluenzaA__AGO00289

SEQ ID NO: 162619 - RNA, 1698 nt, Artificial Sequence
  derived and/or modified sequence opt4 from hemagglutinin__InfluenzaA__AGO00301
augaaggccaagcugcugauccugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaaggccccccugcagcugggcaacugcaacaucgccggcugggugcugggcaaccccgagugcgagagccugcugagcaacagaagcuggagcuacaucgccgagacccccaacagcgagaacggcaccugcuaccccggcgacuucgccgacuacgaggagcugagagagcagcugagcagcgugagcagcuucgagagauucgagaucuuccccaaggagagaagcuggcccaaccacaccaccagaggcgugaccgccgccugcccccacgccagaaagagcagcuucuacaagaaccugguguggcugaccgaggccaacggcagcuaccccaaccugagcagaagcuacgugaacaaccaggagaaggaggugcuggugcuguggggcgugcaccaccccagcaacaucgaggagcagagagcccuguacagaaaggacaacgccuacgugagcguggugagcagcaacuacaacagaagauucacccccgagaucgccaagagacccaaggugagagaccagagcggcagaaugaacuacuacuggacccugcuggagcccggcgacaccaucaucuucgaggccaccggcaaccugaucgcccccugguacgccuucgcccugagcagaggccccggcagcggcaucaucaccagcaacgccccccuggacgagugcgacaccaagugccagaccccccagggcgccaucaacagcagccugcccuuccagaacauccaccccgugaccaucggcgagugccccaaguacgugagaagcaccaagcugagaauggugaccggccugagaaacauccccagcgugcagagcagaggccuguucggcgccaucgccggcuucaucgagggcggcuggaccggcaugauggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuucauggacaucuggaccuacaacgccgagcugcuggugcugcuggagaacgagagaacccuggacuuccacgacagcaacgugaagaaccuguacgagaaggugaagaaccagcugagaaacaacgccaaggagcugggcaacggcugcuucgaguucuaccacaagugcgacaacgagugcauggagagcgugaagaacggcaccuacgacuaccccaaguacagcgaggagagcaagcugaacagagagaagaucgacggcgugaagcuggagagcaugggcguguacagaauccuggccaucuacagcaccguggccagcagccuggugcugcuggugagccugggcgccaucagcuucuggaugugcagcaacggcagccugcagugcagaaucugcaucuga

SEQ ID NO: 162620 - RNA, 1701 nt, Artificial Sequence
  derived and/or modified sequence opt4 from hemagglutinin__InfluenzaA__AGO00313
augaagaccaucaucgcccugagcuacaucuucugccaggugcuggcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcuacgccugcaagagaggccccgacaacagcuucuucagcagacugaacuggcuguacaagagcgagagcaccuaccccgugcugaacgugaccaugcccaacaacgacaacuucgacaagcuguacaucuggggcgugcaccaccccagcaccgacaaggagcagaccaaccuguacgugcaggccagcggcagagugaccgugagcaccaagagaagccagcagaccaucauccccaacgugggcagcagacccugggugagaggccugagcagcggcaucagcaucuacuggaccaucgugaagcccggcgacauccugcugaucaacagcaacggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 162621 - RNA, 1704 nt, Artificial Sequence; identical to SEQ ID NO: 161617
  derived and/or modified sequence opt4 from hemagglutinin__InfluenzaA__AGO00325

SEQ ID NO: 162622 - RNA, 1698 nt, Artificial Sequence
  derived and/or modified sequence opt4 from hemagglutinin__InfluenzaA__AGO00337
augaaggccaaccugcuggugcugcugagcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaaccacaacaccaacggcgugaccgccgccugcagccacgagggcaagagcagcuucuacagaaaccugcuguggcugaccgagaaggagggcagcuaccccaagcugaagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacgugcaccccgugaccaucggcgagugccccaaguacgugagaagcgccaagcugagaauggugaccggccugagaaacacccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 162623 - RNA, 1698 nt, Artificial Sequence; identical to SEQ ID NO: 155798
  derived and/or modified sequence opt4 from hemagglutinin__InfluenzaA__AGO00349

SEQ ID NO: 162624 - RNA, 1698 nt, Artificial Sequence
  derived and/or modified sequence opt4 from hemagglutinin__InfluenzaA__AGO00373
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccgaccacaacaccaacggcgugaccgccgccugcagccacgagggcaagagcagcuucuacagaaaccugcuguggcugaccgagaaggagagcagcuaccccaagcugaagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacaugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 162625 - RNA, 1698 nt, Artificial Sequence
  derived and/or modified sequence opt4 from hemagglutinin__InfluenzaA__AGO00385
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugggcagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccgaccacaacaccaacggcgugaccgccgccugcagccacgagggcaagagcagcuucuacagaaaccugcuguggcugaccgagaaggagagcagcuaccccaagcugaagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 162626 - RNA, 1698 nt, Artificial Sequence
  derived and/or modified sequence opt4 from hemagglutinin__InfluenzaA__AGO00397
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugggcagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccgaccacaacaccaacggcgugaccgccgccugcagccacgagggcaagagcagcuucuacagaaaccugcuguggcugaccgagaaggagagcagcuaccccaagcugaagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugaaggaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 162627 - RNA, 1698 nt, Artificial Sequence
  derived and/or modified sequence opt4 from hemagglutinin__InfluenzaA__AGO00409
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugggcagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccgaccacaacaccaacggcgugaccgccgccugcagccacgagggcaagaacagcuucuacagaaaccugcuguggcugaccgagaagaagagcagcuaccccgagcugaagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugaaggaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 162628 - RNA, 1698 nt, Artificial Sequence
  derived and/or modified sequence opt4 from hemagglutinin__InfluenzaA__AGO00421
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcaagcugaagggcaucgccccccugcagcugggcaagugcaacaucgccggcuggcugcugggcaaccccggcugcgacccccugcugcccgugggcagcuggagcuacaucguggagacccccaacagcgagaacggcaucugcuaccccggcgacuucaucgacuacgaggagcugagagagcagcugagcagcgugagcagcuucgagagauucaagaucuuccccaaggagagcagcuggcccgaccacaacaccaccggcgugaccgccgccugcagccacgagggcaagaacagcuucuacagaaaccugcuguggcugaccaagaaggagagcagcuaccccgagcugaagaacagcuacgugaacaagaagagaaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugaagggccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 162629 - RNA, 1698 nt, Artificial Sequence
  derived and/or modified sequence opt4 from hemagglutinin__InfluenzaA__AGO00433
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaaccacaacaccaacggcgugaccgccgccugcagccacgagggcaagagcagcuucuacagaaaccugcuguggcugaccgagaaggagggcagcuaccccaagcuggagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 162630 - RNA, 1698 nt, Artificial Sequence
  derived and/or modified sequence opt4 from hemagglutinin__InfluenzaA__AGO00445
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaaccacaacaccaacggcgugaccgccgccugcagccacgagggcaagagcagcuucuacagaaaccugcuguggcugaccgagaaggagggcagcuaccccacccugaagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 162631 - RNA, 1701 nt, Artificial Sequence
  derived and/or modified sequence opt4 from hemagglutinin__InfluenzaA__AGO02696
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaucagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 162632 - RNA, 1701 nt, Artificial Sequence; identical to SEQ ID NO: 162560
  derived and/or modified sequence opt4 from hemagglutinin__InfluenzaA__AGO02697

SEQ ID NO: 162633 - RNA, 1701 nt, Artificial Sequence; identical to SEQ ID NO: 162378
  derived and/or modified sequence opt4 from hemagglutinin__InfluenzaA__AGO02698

SEQ ID NO: 162634 - RNA, 1701 nt, Artificial Sequence; identical to SEQ ID NO: 162378
  derived and/or modified sequence opt4 from hemagglutinin__InfluenzaA__AGO02699

SEQ ID NO: 162635 - RNA, 1701 nt, Artificial Sequence
  derived and/or modified sequence opt4 from hemagglutinin__InfluenzaA__AGO02700
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccaggccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgcccagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccagauacagcgaggaggccaagcugaacagagaggagaucgacggcaucaagcuggagagcaccagaaucuaccagauccuggccaucuacagcaccguggccagcagccuggugcugaucgugagccugggcgccaucagcuucuggaugugcagcaacggcagccugcagugcagaaucugcaucuga

SEQ ID NO: 162636 - RNA, 1701 nt, Artificial Sequence
  derived and/or modified sequence opt4 from hemagglutinin__InfluenzaA__AGO02701
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagccacuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacggccagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162637 - RNA, 1683 nt, Artificial Sequence; identical to SEQ ID NO: 162508
  derived and/or modified sequence opt4 from hemagglutinin__InfluenzaA__AGO51374

SEQ ID NO: 162638 - RNA, 1701 nt, Artificial Sequence
  derived and/or modified sequence opt4 from hemagglutinin__InfluenzaA__AGO86686
augaagaccaucaucgcccugagcuacauccugugccuggccuucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcuggagaacagauaccccgcccugaacgugaccaugcccaacaacgacaaguucgacaagcuguacaucuggggcgugcaccaccccagcaccgacagcgaccagaucagcguguacgcccaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacaagcugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaccuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 162639 - RNA, 1701 nt, Artificial Sequence; identical to SEQ ID NO: 162560
  derived and/or modified sequence opt4 from hemagglutinin__InfluenzaA__AGQ16240

SEQ ID NO: 162640 - RNA, 1701 nt, Artificial Sequence; identical to SEQ ID NO: 162560
  derived and/or modified sequence opt4 from hemagglutinin__InfluenzaA__AGQ16241

SEQ ID NO: 162641 - RNA, 1701 nt, Artificial Sequence
  derived and/or modified sequence opt4 from hemagglutinin__InfluenzaA__AGQ16242
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaccagcuacaucaacgacaagggcaaggagauccuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162642 - RNA, 1701 nt, Artificial Sequence; identical to SEQ ID NO: 162580
  derived and/or modified sequence opt4 from hemagglutinin__InfluenzaA__AGQ16243

SEQ ID NO: 162643 - RNA, 1701 nt, Artificial Sequence
  derived and/or modified sequence opt4 from hemagglutinin__InfluenzaA__AGQ16245
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162644 - RNA, 1701 nt, Artificial Sequence; identical to SEQ ID NO: 162580
  derived and/or modified sequence opt4 from hemagglutinin__InfluenzaA__AGQ16247

SEQ ID NO: 162645 - RNA, 1701 nt, Artificial Sequence
  derived and/or modified sequence opt4 from hemagglutinin__InfluenzaA__AGQ16248
augcaggccauccugguggugcugcuguacaccuucgccaccgccaccgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccauccacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162646 - RNA, 1701 nt, Artificial Sequence; identical to SEQ ID NO: 162378
  derived and/or modified sequence opt4 from hemagglutinin__InfluenzaA__AGQ16329

SEQ ID NO: 162647 - RNA, 1701 nt, Artificial Sequence; identical to SEQ ID NO: 162403
  derived and/or modified sequence opt4 from hemagglutinin__InfluenzaA__AGQ16331

SEQ ID NO: 162648 - RNA, 1701 nt, Artificial Sequence; identical to SEQ ID NO: 162378
  derived and/or modified sequence opt4 from hemagglutinin__InfluenzaA__AGQ16332

SEQ ID NO: 162649 - RNA, 1701 nt, Artificial Sequence; identical to SEQ ID NO: 162378
  derived and/or modified sequence opt4 from hemagglutinin__InfluenzaA__AGQ16333

SEQ ID NO: 162650 - RNA, 1701 nt, Artificial Sequence
  derived and/or modified sequence opt4 from hemagglutinin__InfluenzaA__AGQ16335
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccaggugcuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162651 - RNA, 1701 nt, Artificial Sequence
  derived and/or modified sequence opt4 from hemagglutinin__InfluenzaA__AGQ16336
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagaagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162652 - RNA, 1701 nt, Artificial Sequence; identical to SEQ ID NO: 162650
  derived and/or modified sequence opt4 from hemagglutinin__InfluenzaA__AGQ16337

SEQ ID NO: 162653 - RNA, 1701 nt, Artificial Sequence; identical to SEQ ID NO: 162388
  derived and/or modified sequence opt4 from hemagglutinin__InfluenzaA__AGQ16338

SEQ ID NO: 162654 - RNA, 1701 nt, Artificial Sequence
  derived and/or modified sequence opt4 from hemagglutinin__InfluenzaA__AGQ16339
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaagaacuggauccuguggaucagcuucgccaucagcugcuuccugcugugcguggcccugcugggcuucaucaugugggccugccagaagggcaacaucagaugcaacaucugcaucuga

SEQ ID NO: 162655 - RNA, 1701 nt, Artificial Sequence; identical to SEQ ID NO: 162514
  derived and/or modified sequence opt4 from hemagglutinin__InfluenzaA__AGQ16340

SEQ ID NO: 162656 - RNA, 1701 nt, Artificial Sequence; identical to SEQ ID NO: 162378
  derived and/or modified sequence opt4 from hemagglutinin__InfluenzaA__AGQ16341

SEQ ID NO: 162657 - RNA, 1701 nt, Artificial Sequence; identical to SEQ ID NO: 162388
  derived and/or modified sequence opt4 from hemagglutinin__InfluenzaA__AGQ16342

SEQ ID NO: 162658 - RNA, 1701 nt, Artificial Sequence
  derived and/or modified sequence opt4 from hemagglutinin__InfluenzaA__AGQ16343
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162659 - RNA, 1701 nt, Artificial Sequence; identical to SEQ ID NO: 162388
  derived and/or modified sequence opt4 from hemagglutinin__InfluenzaA__AGQ16344

SEQ ID NO: 162660 - RNA, 1701 nt, Artificial Sequence; identical to SEQ ID NO: 162378
  derived and/or modified sequence opt4 from hemagglutinin__InfluenzaA__AGQ16345

SEQ ID NO: 162661 - RNA, 1701 nt, Artificial Sequence
  derived and/or modified sequence opt4 from hemagglutinin__InfluenzaA__AGQ16346
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcagaagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162662 - RNA, 1701 nt, Artificial Sequence; identical to SEQ ID NO: 162378
  derived and/or modified sequence opt4 from hemagglutinin__InfluenzaA__AGQ16347

SEQ ID NO: 162663 - RNA, 1701 nt, Artificial Sequence; identical to SEQ ID NO: 162514
  derived and/or modified sequence opt4 from hemagglutinin__InfluenzaA__AGQ16348

SEQ ID NO: 162664 - RNA, 1701 nt, Artificial Sequence; identical to SEQ ID NO: 162378
  derived and/or modified sequence opt4 from hemagglutinin__InfluenzaA__AGQ16349

SEQ ID NO: 162665 - RNA, 1701 nt, Artificial Sequence
  derived and/or modified sequence opt4 from hemagglutinin__InfluenzaA__AGQ16350
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucauguggaccugccagaagggcaacaucagaugcaacaucugcaucuga

SEQ ID NO: 162666 - RNA, 1701 nt, Artificial Sequence
  derived and/or modified sequence opt4 from hemagglutinin__InfluenzaA__AGQ47719
augaaggccauccugcuggugcugcugugcaccuucaccgccaccaacgccgacacccugugcaucggcuaccacgccaacaacagcaccgacaccguggacaccgugcuggagaagaacgugaccgugacccacagcgugaaccugcuggaggacagacacaacggcaagcugugcaagcugggcggcaucgccccccugcaccugggcaagugcaacaucgccggcuggcugcugggcaaccccgagugcgagcugcuguucaccgugagcagcuggagcuacaucguggagaccagcaacagcgacaacggcaccugcuaccccggcgacuucaucaacuacgaggagcugagagagcagcugagcagcgugagcagcuucgagagauucgagaucuuccccaagaccagcagcuggcccgaccacgagaccaacagaggcgugaccgccgccugccccuacgccggcgccaacagcuucuacagaaaccugaucuggcuggugaagaagggcaacagcuaccccaagcugagcaagagcuacgugaacaacaagggcaaggaggugcuggugcuguggggcauccaccacccccccaccagcaccgaccagcagagccuguaccagaacgccgacgccuacguguucgugggcagcagcaaguacaacagaaaguucaagcccgagaucgccgccagacccaaggugagaggccaggccggcagaaugaacuacuacuggacccugaucgagcccggcgacaccaucaccuucgaggccaccggcaaccugguggugcccagauacgccuucgccaugaacagaggcagcggcagcggcaucaucaucagcgacgcccccauccacgacugcaacaccaagugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacggccagggcagcggcuacgccgccgaccagaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacguguggaccuacaacgccgagcugcuggugcugcuggagaacgagagaacccuggacuuccacgacagcaacgugaagaaccuguacgagaaggugagaagccagcugagaaacaacgccaaggagaucggcaacggcugcuucgaguucuaccacaagugcgacgacaccugcauggagagcgugaagaacggcaccuacgacuaccccaaguacagcgaggagagcaagcugaacagagaggagaucgacggcgugaagcuggagagcaccagaaucuaccagauccuggccaucuacagcaccgccgccagcagccuggugcugcuggugagccugggcgccaucagcuucuggaugugcagcaacggcagccugcagugcagaaucugcaucuga

SEQ ID NO: 162667 - RNA, 1698 nt, Artificial Sequence; identical to SEQ ID NO: 154635
  derived and/or modified sequence opt4 from hemagglutinin__InfluenzaA__AGQ47728

SEQ ID NO: 162668 - RNA, 1701 nt, Artificial Sequence
  derived and/or modified sequence opt4 from hemagglutinin__InfluenzaA__AGQ47740
augaaggccagacugcuggugcugcugugcgcccuggccgccaccgacgccgacaccaucugcaucggcuaccacgccaacaacagcaccgacaccguggacacccugcuggagaagaacgugaccgugacccacagcgugaaccugcuggaggacagccacaacggcaagcugugcaagcugaagggcaucgccccccugcagcugggcaagugcaacaucgccggcuggcugcugggcaaccccgagugcgacagccugcugcccgccagaagcuggagcuacaucguggagacccccaacagcgagaacggcgccugcuaccccggcgacuucaucgacuacgaggagcugagagagcagcugagcagcgugagcagccuggagagauucgagaucuuccccaaggagagcagcuggcccaaccacaacaccaucaagggcgugaccgccagcugcagccacagaggccagagcagcuucuacagaaaccugcuguggcugaccaagaagggcgacagcuaccccaagcugaacaacagcuacgugaacaacaagggcaaggaggugcuggugcuguggggcgugcaccaccccagcagcagcaacgagcagcagagccuguacagaaacgagaacgccuacgugagcguggugagcagcaacuacaacagaagauucacccccgagaucgccgccagacccaaggugagagaccagaccggcagaaugaacuacuacuggacccugcuggagcccggcgacaccaucauguucgaggccaccggcaaccugaucgcccccugguacgccuucgcccugagcagaggcuucggcagcggcaucaucaccagcaacgccagcaugcacgagugcaacaccaagugccagaccccccagggcgccaucaacagcagccugcccuuccagaacauccaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaaccuggagaagagaauggagaaccugaacaagaagguggacgacggcuuccuggacaucuggaccuacaacgccgagcugcuggugcugcuggagaacgagagaacccuggacuuccacgaccugaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162669 - RNA, 1701 nt, Artificial Sequence
  derived and/or modified sequence opt4 from hemagglutinin__InfluenzaA__AGQ47752
augaaggccaagcugcugauccugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaaggccccccugcagcugggcaagugcaacaucgccggcugggugcugggcaaccccgagugcgagagccugcugagcaacagaagcuggagcuacaucgccgagacccccaacagcgagaacggcaucugcuaccccggcgacuucgccgacuacgaggagcugagagagcagcugagcagcgugagcagcuucgagagauucgagaucuuccccaaggagagaagcuggcccaagcacaacaccaucagaggcgugaccgccgccugcagccacgccggcaagagcagcuucuacaagaaccugguguggcugaccgaggccaacggcagcuaccccgcccugagcaccagcuacgugaacaaccaggagaaggaggugcuggugcuguggggcgugcaccaccccagcaacaucgaggagcagagaacccuguacagaaaggacaacgccuacgugagcguggugagcagcaacuacaacagaagauucacccccgagaucgccaagagacccaaggugagagaccagcccggcagaaugaacuacuacuggacccugcuggagcccggcgacaccaucaucuucgaggccaccggcaaccugaucgcccccugguacgccuucgcccugagcagaggccccggcagcggcaucaucaccagcaacgcccccauggacgagugcgacaccaagugccagaccccccagggcgccaucaacagcagccugcccuuccagaacauccaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugauggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugagaaacaacgccaaggagcugggcaacggcugcuucgaguucuaccacaagugcgacaacgagugcauggagagcgugaagaacggcaccuacgacuaccccaaguacagcgaggagagcaagcugaacagagagaagaucgacggcgugaagcuggagagcaugggcguguacagaauccuggccaucuacagcaccguggccagcagccuggugcugcuggugagccugggcgccaucagcuucuggaugugcagcaacggcagccugcagugcagaaucugcaucuga

SEQ ID NO: 162670 - RNA, 1701 nt, Artificial Sequence
  derived and/or modified sequence opt4 from hemagglutinin__InfluenzaA__AGQ47764
augaaggccaagcugcugauccugcugugcgcccugaccgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggauccugggcaaccccgagugcgagagccugcugagcaagagaagcuggagcuacaucgccgagacccccaacagcgagaacggcgccugcuaccccggcgacuucgccgacuacgaggagcugagagagcagcugagcagcgugagcagcuucgagagauucgagaucuuccccaaggagagaagcuggcccaagcacaacaucaccagaggcgugaccgccgccugcagccacgccggcaagagcagcuucuacaagaaccugcuguggcugaccgagaccgacggcagcuaccccaagcugagcaagagcuacgugaacaacaaggagaaggaggugcuggugcuguggggcgugcaccaccccagcaacaucgaggaccagaagacccuguacagaaaggagaacgccuacgugagcguggugagcagcaacuacaacagaagauucacccccgagaucgccgagagacccaaggugagaggccaggccggcagaaucaacuacuacuggacccugcuggagcccggcgacaccaucaucuucgaggccaacggcaaccugaucgcccccugguacgccuucgcccugagcagagacuucggcagcggcaucaucaccagcaacgccagcauggacgagugcgacaccaagugccagaccccccagggcgccaucaacagcagccugcccuuccagaacauccaccccgugaccaucggcgagugccccaaguacgugaagagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugagaaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162671 - RNA, 1701 nt, Artificial Sequence
  derived and/or modified sequence opt4 from hemagglutinin__InfluenzaA__AGQ47776
augaaggccaagcugcugauccugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggauccugggcaaccccgagugcgagagccugcugagcaagagaagcuggagcuacaucgccgagacccccaacagcgagaacggcaccugcuaccccggcgacuucgccgacuacgaggagcugagagagcagcugagcagcgugagcagcuucgagagauucgagaucuuccccaaggagagaagcuggcccaagcacaacaucaacaucggcgugaccgccgccugcagccacgccggcaagagcagcuucuacaagaaccugcuguggcugaccgagaaggacggcagcuaccccaaccugaacaagagcuacgugaacaagaaggagaaggaggugcuggugcuguggggcgugcaccaccccagcaacaucgaggaccagaagacccuguacagaaaggagaacgccuacgugagcguggugagcagcaacuacaacagaagauucacccccgagaucgccgagagacccaaggugagaggccaggccggcagaaugaacuacuacuggacccugcuggagcccggcgacaccaucaucuucgaggccaacggcaaccugaucgcccccugguacgccuucgcccugagcagaggccugggcagcggcaucaucaccagcaacgccagcauggacgagugcgacaccaagugccagaccccccagggcgccaucaacagcagccugcccuuccagaacauccaccccuucaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugagaaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162672 - RNA, 1701 nt, Artificial Sequence
  derived and/or modified sequence opt4 from hemagglutinin__InfluenzaA__AGQ47788
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagaagcuggcccaagcacaacgugaccagaggcgugaccgccgccugcagccacaagggcaagagcagcuucuacagaaaccugcuguggcugaccgagaaggacggcagcuaccccaaccugagcaagagcuacgugaacaacaaggagaaggaggugcuggugcuguggggcgugcaccaccccagcaacaucgaggaccagaagacccuguacagaaaggagaacgccuacgugagcguggugagcagcaacuacaacagaagauucacccccgagaucgccgagagacccaaggugagaggccaggccggcagaaucaacuacuacuggacccugcuggagcccggcgacaccaucaucuucgaggccaacggcaaccugaucgcccccuggcacgccuucgcccugagcagaggcuucggcagcggcaucaucaccagcaacgccagcauggacgagugcgacaccaagugccagaccccccagggcgccaucaacagcagccugcccuuccagaacauccaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162673 - RNA, 1701 nt, Artificial Sequence
  derived and/or modified sequence opt4 from hemagglutinin__InfluenzaA__AGQ47800
augaaggccagacugcuggugcugcugugcgcccuggccgccaccgacgccgacaccaucugcaucggcuaccacgccaacaacagcaccgacaccguggacaccauccuggagaagaacgugaccgugacccacagcgugaaccugcuggaggacagccacaacggcaagcugugcagacugaagggcaucgccccccugcagcugggcaagugcaacaucgccggcuggauccugggcaaccccgagugcgagagccugcugagcgagagaagcuggagcuacaucguggagauccccaacagcgagaacggcaccugcuaccccggcgacuucaccgacuacgaggagcugagagagcagcugagcagcgugagcagcuucgagagauucgagaucuuccccaaggagagcagcuggcccaagcacaacaccgccagaggcgugaccgccgccugcagccacgccggcaagagcagcuucuacagaaaccugcuguggcugaccgagaaggacggcagcuaccccaaccugaagaacagcuacgugaacaagaagggcaaggaggugcuggugcuguggggcgugcaccaccccagcagcaucaaggagcagcagacccuguaccagaaggagaacgccuacgugagcguggugagcagcaacuacaacagaagauucacccccgagaucgccgagagacccaaggugagagaccaggccggcagaaugaacuacuacuggacccugcuggagcccggcgacaccaucaucuucgaggccaacggcaaccugaucgcccccugguacgccuucgcccugagcagaggcuucggcagcggcaucaucaccagcaacgccagcaugcacgagugcgacaccaagugccagaccccccagggcgccaucaacagcagccugcccuuccagaacauccaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaaccuggagaagagaauggagaaccugaacaagaagguggacgacggcuuccuggacaucuggaccuacaacgccgagcugcugauccugcuggagaacgagagaacccuggacuuccacgacagcaacgugaagaaccuguacgagaaggugaagagccagcugagaaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162674 - RNA, 1701 nt, Artificial Sequence
  derived and/or modified sequence opt4 from hemagglutinin__InfluenzaA__AGQ47811
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggauccugggcaaccccgagugcgagagccuguucagcaagaagagcuggagcuacaucgccgagacccccaacagcgagaacggcaccugcuaccccggcuucuucgccgacuacgaggagcugagagagcagcugagcagcgugagcagcuucgagagauucgagaucuuccccaaggagagaagcuggcccaagcacaacgugaccagaggcgugaccgccgccugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagcaacuacaacagaagauucacccccgagaucgccgagagacccaaggugagaggccaggccggcagaaucaacuacuacuggacccugcuggagcccggcgacaccaucaucuucgaggccaacggcaaccugaucgcccccuggcacgccuucgcccugagcagaggcuucggcagcggcaucaucaccagcaacgccagcauggacgagugcgacaccaagugccagaccccccagggcgccaucaacagcagccugcccuuccagaacauccaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucgacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162675 - RNA, 1701 nt, Artificial Sequence
  derived and/or modified sequence opt4 from hemagglutinin__InfluenzaA__AGQ47823
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaacugcagcguggccggcuggauccugggcaaccccaagugcgagagccuguucagcaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccaccagcugcagccacaacggcaagagcagcuucuacagaaaccugcuguggcugaccgagaagaacggccuguaccccaaccugagcaagagcuacgugaacaacaaggagaaggaggugcuggugcuguggggcgugcaccaccccagcaacaucagagaccagagagccaucuaccacaccgagaacgccuacgugagcguggugagcagccacuacagcagaagauucacccccgagaucgccaagagacccaaggugagaggccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacggcagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagaggcaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162676 - RNA, 1701 nt, Artificial Sequence
  derived and/or modified sequence opt4 from hemagglutinin__InfluenzaA__AGQ47835
augaagaccaucaucgcccugagcuacaucuucugccuggugcugggccaggacuuccccggcaacgacaacagcaccgccacccugugccugggccaccacgccgugcccaacggcaccaucgugaagaccaucaccaacgaccagaucgaggugaccaacgccaccgagcuggugcagagcagcagcaccggcaagaucugcaacaacccccacagaauccuggacggcaucaacugcacccugaucgacgcccugcugggcgacccccacugcgacggcuuccagaacgagaccugggaccuguucguggagagaagcaaggccuucagcaacugcuaccccuacuacgugcccgacuacgccagccugagaagccugguggccagcagcggcacccuggaguucaucaacgagggcuucaacuggaccggcgugacccagaacggcggcagcaacgccugcaagagaggccccaacagcggcuucuucagcagacugaacuggcuguacaagagcggcaccaccuaccccgugcugaacgugaccaugcccaacaacgacaacuucgacaagcuguacaucuggggcgugcaccaccccagcaccgaccaggagcagaccaaccuguacgugcaggccagcggcagagugaccgugagcaccaagagaagccagcagaccaucacccccaacaucggcagcagacccugggugagaggccugagcagcagaaucagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 162677 - RNA, 1701 nt, Artificial Sequence
  derived and/or modified sequence opt4 from hemagglutinin__InfluenzaA__AGQ47847
augaaggccagacugcugauccugcugugcgcccuggccgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacagccugcugcccgccagcagcuggagcuacaucguggagacccccaacagcaagaacggcaucugcuaccccggcgacuucaucgacuacgaggagcugagagagcagcugagcagcgugagcagcuucgagagauucgagaucuuccccaaggagagcagcuggcccaagcacaacaccaccaagggcgugaccgccgccugcagccacgccggcaagagcagcuucuacagaaaccugcuguggcugaccaagaaggaggacagcuaccccaagcugagcaacagcuacgugaacaagaagggcaaggaggugcuggugcuguggggcgugcaccaccccagcaacagcaaggagcagcagacccuguaccagaacgagaacgccuacgugagcguggugagcagcaacuacaacagaagauucacccccgagaucgccgagagacccaaggugagagaccaggccggcagaaugaacuacuacuggacccugcuggagcccggcgacaccaucaucuucgaggccaacggcaaccugaucgcccccugguacgccuucgcccugagcagaggcuucggcagcggcaucaucaccagcaacgccagcaugcacgagugcaacaccaagugccagaccccccagggcgccaucaacagcagccugcccuuccagaacauccaccccgugaccaucggcgagugccccaaguacgugaagagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaaccuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagauccagcugaagaacaacgccaaggagaucggcaacggcugcuucgaguucuaccacaagugcgacaacgagugcauggagagcgugagaaacggcaccuacgacuaccccaaguacagcaaggagagcaagcugaacagagagaagaucgacggcgugaagcuggagcccaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162678 - RNA, 1701 nt, Artificial Sequence
  derived and/or modified sequence opt4 from hemagglutinin__InfluenzaA__AGQ47870
augaaggccauccugcuggugcugcugugcaccuucgccgccaccaacgccgacacccugugcaucggcuaccacgccaacaacagcaccgacaccguggacaccgugcuggagaagaacgugaccgugacccacagcgugaaccugcuggaggacagacacaacggcaagcugugcaagcugggcggcaucgccccccugcaccugggcaagugcaacaucgccggcuggcugcugggcaaccccgagugcgagcugcugcugaccgugagcagcuggagcuacaucguggagaccagcaacagcgacaacggcaccugcuaccccggcgacuucaucaacuacgaggagcugagagagcagcugagcagcgugagcagcuucgagagauucgagaucuuccccaagaccagcagcuggcccaaccacgagaccaacagaggcgugaccgccgccugccccuacgccggcgccaacagcuucuacagaaaccugaucuggcuggugaagaagggcaacagcuaccccaagcugagcaagagcuacgugaacaacaagggcaaggaggugcuggugcuguggggcauccaccacccccccaccagcaccgaccagcagagccuguaccagaacgccgacgccuacguguucgugggcagcagcaaguacaacagaaaguucaagcccgagaucgccgccagacccaaggugagaggccaggccggcagaaugaacuacuacuggacccugaucgagcccggcgacaccaucaccuucgaggccaccggcaaccugguggugcccagauacgccuucgccaugaacagaggcagcggcagcggcaucaucaucagcgacgcccccgugcacgacugcaacaccaagugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagagaagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuuccacgacagcaacgugaagaaccuguacgagaaggugagaagccagcugagaaacaacgccaaggagaucggcaacggcugcuucgaguucuaccacaagugcgacgacaccugcauggagagcgugaagaacggcaccuacgacuaccccaaguacagcgaggagagcaagcugaacagagaggagaucgacggcgugaagcuggagagcaccagaaucuaccagauccuggccaucuacagcaccguggccagcagccuggugcugcuggugagccugggcgccaucagcuucuggaugugcagcaacggcagccugcagugcagaaucugcaucuga

SEQ ID NO: 162679 - RNA, 1701 nt, Artificial Sequence
  derived and/or modified sequence opt4 from hemagglutinin__InfluenzaA__AGQ47882
augaaggccauccugcuggugcugcugugcaccuucgccgccaccaacgccgacacccugugcaucggcuaccacgccaacaacagcaccgacaccguggacaccgugcuggagaagaacgugaccgugacccacagcgugaaccugcuggaggacagacacaacggcaagcugugcaagcugggcggcaucgccccccugcaccugggcaagugcaacaucgccggcuggcugcugggcaaccccgagugcgagcugcugcugaccgugagcagcuggagcuacaucguggagaccagcaacagcgacaacggcaccugcuaccccggcgacuucaucaacuacgaggagcugagagagcagcugagcagcgugagcagcuucgagagauucgagaucuuccccaagaccagcagcuggcccaaccacgagaccaacagaggcgugaccgccgccugccccuacgccggcgccaacagcuucuacagaaaccugaucuggcuggugaagaaggagaacagcuaccccaagcugagcaagagcuacgugaacaacaagggcaaggaggugcuggugcuguggggcauccaccacccccccaccagcaccgaccagcagagccuguaccagaacgccgacgccuacguguucgugggcagcagcaaguacaacagaaaguucaagcccgagaucgccgccagacccaaggugagaggccaggccggcagaaugaacuacuacuggacccugaucgagcccggcgacaccaucaccuucgaggccaccggcaaccugguggugcccagauacgccuucgccaugaacagaggcagcggcagcggcaucaucaucagcgacgcccccgugcacgacugcaacaccaagugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagagaagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuuccacgacagcaacgugaagaaccuguacgagaaggugagaagccagcugagaaacaacgccaaggagaucggcaacggcugcuucgaguucuaccacaagugcgacgacaccugcauggagagcgugaagaacggcaccuacgacuaccccaaguacagcgaggagagcaagcugaacagagaggagaucgacggcgugaagcuggagagcaccagaaucuaccagauccuggccaucuacagcaccguggccagcagccuggugcugcuggugagccugggcgccaucagcuucuggaugugcagcaacggcagccugcagugcagaaucugcaucuga

SEQ ID NO: 162680 - RNA, 1701 nt, Artificial Sequence; identical to SEQ ID NO: 161615
  derived and/or modified sequence opt4 from hemagglutinin__InfluenzaA__AGQ47894

SEQ ID NO: 162681 - RNA, 1701 nt, Artificial Sequence
  derived and/or modified sequence opt4 from hemagglutinin__InfluenzaA__AGQ47906
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcauccaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 162682 - RNA, 1701 nt, Artificial Sequence
  derived and/or modified sequence opt4 from hemagglutinin__InfluenzaA__AGQ47918
augaagaccaucaucgcccugagcuacaucuucugccuggcccugggccaggaccugcccggcaacgacaacaacaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 162683 - RNA, 1701 nt, Artificial Sequence
  derived and/or modified sequence opt4 from hemagglutinin__InfluenzaA__AGQ47930
augaaggccaaccugcuggugcugcugugcgcccuggccgccgccgacgccgacaccaucugcaucggcuaccacgccaacaacagcaccgacaccguggacaccgcccuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaaccacaacaccaacaagggcgugaccgccgccugcagccacgccggcaagagcagcuucuacagaaaccugcuguggcugaccgagaaggagggcagcuaccccaagcugaagaacagcuacgugaacaagaagggcaaggaggugcuggugcuguggggcauccaccaccccagcaacagcaaggaccagcagaaccuguaccagaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuuccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 162684 - RNA, 1698 nt, Artificial Sequence; identical to SEQ ID NO: 155798
  derived and/or modified sequence opt4 from hemagglutinin__InfluenzaA__AGQ47942

SEQ ID NO: 162685 - RNA, 1698 nt, Artificial Sequence
  derived and/or modified sequence opt4 from hemagglutinin__InfluenzaA__AGQ47954
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaaccacaacaccaacggcgugaccgccgccugcagccacgagggcaagagcagcuucuacagaaaccugcuguggcugaccgagaaggagggcagcuaccccaagcugaagaacagcuacgugaacaagaagggcaaggaggugcuggugcuguggggcauccaccacccccccaacagcaaggagcagcagaaccuguacagaaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 162686 - RNA, 1698 nt, Artificial Sequence
  derived and/or modified sequence opt4 from hemagglutinin__InfluenzaA__AGQ47966
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugggcagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccgaccacaacaccaacggcgugaccgccgccugcagccacgagggcaagaacagcuucuacagaaaccugcuguggcugaccgagaaggagagcagcuaccccaagcugaagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugaaggaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 162687 - RNA, 1698 nt, Artificial Sequence
  derived and/or modified sequence opt4 from hemagglutinin__InfluenzaA__AGQ47978
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugggcagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccgaccacaacaccaacggcgugaccgccgccugcagccacgagggcaagaacagcuucuacagaaaccugcuguggcugaccaagaaggagagcagcuaccccgagcugaagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugaaggaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 162688 - RNA, 1698 nt, Artificial Sequence
  derived and/or modified sequence opt4 from hemagglutinin__InfluenzaA__AGQ47990
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugggcagcuggagcuacaucguggagacccccaacagcgagaacggcaucugcuaccccggcgacuucaucgacuacgaggagcugagagagcagcugagcagcgugagcagcuucgagagauucaagaucuuccccaaggagagcagcuggcccgaccacaacaccaacggcgugaccgccgccugcagccacgagggcaagaacagcuucuacagaaaccugcuguggcugaccaagaaggagagcagcuaccccgagcugaagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugaaggaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 162689 - RNA, 1698 nt, Artificial Sequence
  derived and/or modified sequence opt4 from hemagglutinin__InfluenzaA__AGQ48002
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugggcagcuggagcuacaucguggagacccccaacagcgagaacggcaucugcuaccccggcgacuucaucgacuacgaggagcugagagagcagcugagcagcgugagcagcuucgagagauucaagaucuuccccaaggagagcagcuggcccgaccacaacaccaacggcgugaccgccgccugcagccacgagggcaagaacagcuucuacagaaaccugcuguggcugaccaagaaggagagcagcuaccccgagcugaagaacagcuacgugaacaagaagagaaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugaaggaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 162690 - RNA, 1698 nt, Artificial Sequence
  derived and/or modified sequence opt4 from hemagglutinin__InfluenzaA__AGQ48014
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccggcugcgacccccugcugcccgugggcagcuggagcuacaucguggagacccccaacagcgagaacggcaucugcuaccccggcgacuucaucgacuacgaggagcugagagagcagcugagcagcgugagcagcuucgagagauucaagaucuuccccaaggagagcagcuggcccgaccacaacaccaacggcgugaccgccgccugcagccacgagggcaagaacagcuucuacagaaaccugcuguggcugaccaagaaggagagcagcuaccccgagcugaagaacagcuacgugaacaagaagagaaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugaaggaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 162691 - RNA, 1698 nt, Artificial Sequence
  derived and/or modified sequence opt4 from hemagglutinin__InfluenzaA__AGQ48026
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcaagcugaagggcaucgccccccugcagcugggcaagugcaacaucgccggcuggcugcugggcaaccccggcugcgacccccugcugcccgugggcagcuggagcuacaucguggagacccccaacagcgagaacggcaucugcuaccccggcgacuucaucgacuacgaggagcugagagagcagcugagcagcgugagcagcuucgagagauucaagaucuuccccaaggagagcagcuggcccgaccacaacaccaacggcgugaccgccgccugcagccacgagggcaagaacagcuucuacagaaaccugcuguggcugaccaagaaggagagcagcuaccccgagcugaagaacagcuacgugaacaagaagagaaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugaaggaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 162692 - RNA, 1698 nt, Artificial Sequence
  derived and/or modified sequence opt4 from hemagglutinin__InfluenzaA__AGQ48038
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcaagcugaagggcaucgccccccugcagcugggcaagugcaacaucgccggcuggcugcugggcaaccccggcugcgacccccugcugcccgugggcagcuggagcuacaucguggagacccccaacagcgagaacggcaucugcuaccccggcgacuucaucgacuacgaggagcugagagagcagcugagcagcgugagcagcuucgagagauucaagaucuuccccaaggagagcagcuggcccgaccacaacaccaacggcgugaccgccgccugcagccacgagggcaagaacagcuucuacagaaaccugcuguggcugaccaagaaggagagcagcuaccccgagcugaagaacagcuacgugaacaagaagagagaggaggugcuggugcuguggggcauccaccacccccccaacagcgaggagcagcagaaccuguaccagaacgagaacgccuacgugagcguggugaccagcaacuacaacagaagauucacccccgagaucgccgagagacccaaggugaagggccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 162693 - RNA, 1698 nt, Artificial Sequence
  derived and/or modified sequence opt4 from hemagglutinin__InfluenzaA__AGQ48050
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcaagcugaagggcaucgccccccugcagcugggcaagugcaacaucgccggcuggcugcugggcaaccccggcugcgacccccugcugcccgugggcagcuggagcuacaucguggagacccccaacagcgagaacggcaucugcuaccccggcgacuucaucgacuacgaggagcugagagagcagcugagcagcgugagcagcuucgagagauucaagaucuuccccaaggagagcagcuggcccgaccacaacaccaacggcgugaccgccgccugcagccacgagggcaagaacagcuucuacagaaaccugcuguggcugaccaagaaggagagcagcuaccccgagcugaagaacagcuacgugaacaagaagagagaggaggugcuggugcuguggggcauccaccacccccccgacagcgaggagcagcagaaccuguaccagaacgagaacgccuacgugagcguggugaccagcaacuacaacagaagauucacccccgagaucgccgagagacccaaggugaagggccaggccggcagaaugaacuacuacuggacccugcugaagcccggcgacaccaucaucuucaaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 162694 - RNA, 1689 nt, Artificial Sequence
  derived and/or modified sequence opt4 from hemagglutinin__InfluenzaA__AGQ80946
auggccaucaucuaccugauccugcuguucaccgccgugagaggcgaccagaucugcaucggcuaccacagcaacaacagcaccgagaagguggacaccauccuggagagaaacgugaccgugacccacgcccaggacauccuggagaagacccacaacggcaagcugugcaagcugaacggcauccccccccuggagcugggcgacugcagcaucgccggcuggcugcugggcaaccccgagugcgacagacugcugaccgugcccgaguggagcuacaucauggagaaggagaaccccagaaacggccugugcuaccccggcagcuucaacgacuacgaggagcugaagcaccugcugagcagcgugacccacuucgagaaggugaagauccugcccaaggacagauggacccagcacaccaccaccggcggcagcagagccugcgccgugagcggcaaccccagcuucuucagaaacaugguguggcugaccaagaagggccccaacuaccccguggccaagggcagcuacaacaacaccagcggcgaccagaugcugaucaucuggggcgugcaccaccccaacgacgaggccgagcagagaacccuguaccagaacgugggcaccuacgugagcgugggcaccagcacccugaacaagagaagcgugcccgagaucgccaccagacccaaggugaacggccagggcggcagaauggaguucagcuggaccauccuggacgugcuggacaccaucaacuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacauccacccccugaccaucggcgagugccccaaguacgugaagagcgagagacuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccaucgacggcaucaccaacaaggugaacagcgugaucgagaagaugaacacccaguucgaggccgugggcaaggaguucagcaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgccaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcaacaugggcguguaccagauccuggccaucuacgccaccguggccggcagccugagccuggccaucaugaucgccggcaucagccuguggaugugcagcaacggcagccugcagugcagaaucugcaucuga

SEQ ID NO: 162695 - RNA, 1689 nt, Artificial Sequence
  derived and/or modified sequence opt4 from hemagglutinin__InfluenzaA__AGQ80947
auggccaucaucuaccugauccugcuguucgccaccgugagaggcgaccagaucugcaucggcuaccacagcaacaacagcaccgagaagguggacaccauccuggagagaaacaucaccgugacccacgcccaggacauccuggagaagacccacaacggcaagcugugcaagcugaacggcauccccccccuggagcugggcaacugcagcaucgccggcuggcugcugggcaaccccgagugcgacagacugcugaccgugcccgaguggagcuacaucauggagaaggagaaccccagagacggccugugcuaccccggcagcuucaacgacuacgaggagcugaagcaccugcugagcagcgugacccacuucgagaaggugaagauccugcccaaggacagauggacccagcacaccaccaccggcggcagcagagccugcgccgugagcggcaaccccagcuucuucagaaacaugguguggcugaccaagaagggcagcaacuaccccaucgccaagggcagcuacaacaacaccagcggcgagcagaugcugaucaucuggggcgugcaccaccccaacgacgacgccgagcagagaacccuguaccagaacgugggcaccuacgugagcgugggcaccagcacccugaacaagagaagcauccccgagaucgccaccagacccaaggugaacggccagggcggcagaauggaguucagcuggaccauccuggacaugcuggacaccaucaacuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacauccacccccugaccaucggcgagugccccaaguacgugaagagcgagagacuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccaucgacggcaucaccaacaaggugaacagcgugaucgagaagaugaacacccaguucgaggccgugggcaaggaguucaacaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugaaggacaacgccaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcaacaugggcguguaccagauccuggccaucuacgccaccguggccggcagccugagccuggccaucaugaucgccggcgugagccuguggaugugcagcaacggcagccugcagugcagaaucugcaucuga

SEQ ID NO: 162696 - RNA, 1689 nt, Artificial Sequence
  derived and/or modified sequence opt4 from hemagglutinin__InfluenzaA__AGQ80948
auggccaucaucuaccugauccugcuguucgccgccgugagaggcgaccagaucugcaucggcuaccacagcaacaacagcaccgagaagguggacaccauccuggagagaaacgugaccgugacccacgcccaggacauccuggagaagacccacaacggcaagcugugcaagcugaacggcauccccccccuggagcugggcaacugcagcaucgccggcuggcugcugggcaaccccgagugcgacagacugcugaccgugcccgaguggagcuacaucauggagaaggagaaccccagaaacggccugugcuaccccggcagcuucaacgacuacgaggagcugaagcaccugcugagcagcgugacccacuucgagaaggugaagauccugcccaaggacagauggacccagcacaccaccaccggcggcagcagagccugcgccguguucggcaaccccagcuucuucagaaacaugguguggcugaccaagaagggcagcaacuaccccaucgccaagggcagcuacaacaacaccagcggcgagcagaugcugaucaucuggggcgugcaccaccccaacgacgacgccgagcagagaacccuguaccagaacgugggcaccuacgugagcgugggcaccagcacccugaacaagagaagcauccccgagaucgccaccagacccaaggugaacggccagggcggcagaauggaguucagcuggaccauccuggacaugcuggacaccaucaacuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacauccacccccugaccaucggcgagugccccaaguacgugaagagcgagagacuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccaucgacggcaucaccaacaaggugaacagcgugaucgagaagaugaacacccaguucgaggccgugggcaaggaguucaacaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacgacaagaucagaaugcagcugaaggacaacgccaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcaacaugggcguguaccagauccuggccaucuacgccaccguggccggcagccugagccuggccaucaugaucgccggcaucagccuguggaugugcagcaacggcagccugcagugcagaaucugcaucuga

SEQ ID NO: 162697 - RNA, 1689 nt, Artificial Sequence
  derived and/or modified sequence opt4 from hemagglutinin__InfluenzaA__AGQ80949
auggccaucaucuaccugauccugcuguucgccgccgugagaggcgaccagaucugcaucggcuaccacagcaacaacagcaccgagaagguggacaccauccuggagagaaacgugaccgugacccacgcccaggacauccuggagaagacccacaacggcaagcugugcaagcugaacggcauccccccccuggagcugggcgacugcagcaucgccggcuggcugcugggcaaccccgagugcgacagacugcugaccgugcccgaguggagcuacaucauggagaaggagaaccccagaaacggccugugcuaccccggcagcuucaacgacuacgaggagcugaagcaccugcugagcagcgugacccacuucgagaaggugaagauccugcccaaggacagauggacccagcacaccaccaccggcggcagcagagccugcgccgugagcggcaaccccagcuucuucagaaacaugguguggcugaccaagaagggcagcaacuaccccaucgccaagggcagcuacaacaacaccagcggcgagcagaugcugaucaucuggggcgugcaccaccccaacgacgacgccgagcagagaacccuguaccagaacgugggcaccuacgugagcgugggcaccagcacccugaacaagagaagcauccccgagaucgccaccagacccaaggugaacggccagggcggcagaauggaguucagcuggaccauccuggacaugcuggacaccaucaacuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacauccacccccugaccaucggcgagugccccaaguacgugaagagcgagagacuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccaucgacggcaucaccaacaaggugaacagcgugaucgagaagaugaacacccaguucgaggccgugggcaaggaguucaacaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacgacaagaucagaaugcagcugaaggacaacgccaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcaacaugggcguguaccagauccuggccaucuacgccaccguggccggcagccugagccuggccaucaugaucgccggcaucagccuguggaugugcagcaacggcagccugcagugcagaaucugcaucuga

SEQ ID NO: 162698 - RNA, 1701 nt, Artificial Sequence
  derived and/or modified sequence opt4 from hemagglutinin__InfluenzaA__AGQ80950
augaagaccaucaucgcccugagcuacaucuucugccuggccuucggccagaaccugcccggcaacgacagcagcaccgccacccugugccugggccaccacgccgugcugaacggcaccaucgugaagaccaucaccgacgaccagaucgaggugaccaacgccaccgagcuggugcagagcagcagcaccggcaagaucugcaacaacccccacaagauccuggacggcagagacugcacccugaucgacgcccugcugggcgacccccacugcgacguguuccaggacgagaccugggaccuguucguggagagaagcagcgccuucagcaacugcuaccccuacgacgugcccgacuacgccagccugagaagccugguggccagcagcggcacccuggaguucaucaccgagggcuucaccuggaccggcgugagccagaacggcggcagcggcgccugcaagagaggccccgccaacggcuucuucagcagacugaacuggcugaccaagagcggcaacgccuaccccgugcugaacgugaccaugcccaacagcgacaacuucgacaagcuguacaucuggggcgugcaccaccccagcaccaaccaggagcagaccaaccuguacgugcaggccagcggcagagugaccgugagcaccagaagaagccagcagaccaucauccccaacaucggcagcagacccugggugagaggccagagcggcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgagaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacaucuacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 162699 - RNA, 1695 nt, Artificial Sequence
  derived and/or modified sequence opt4 from hemagglutinin__InfluenzaA__AGQ80951
augcugagcaucgugauccuguuccugcugguggccgagagcagcagccagaacuacaccggcaaccccgugaucugcaugggccaccacgccguggccaacggcaccauggugaagacccugaccgacgaccagguggagguggugaccgcccaggagcugguggagagccagaaccugcccgagcugugccccagcccccugagacugguggacggccagaccugcgacaucaucaacggcgcccugggcagccccggcugcgaccaccugaacggcgccgagugggacaucuucaucgagagacccaacgccauggacaccugcuaccccuucgacgugcccgacuaccagagccugagaagcauccuggccaacaacggcaaguucgaguucaucgccgaggaguuccaguggagcaccgugaagcagaacggcaagagcggcgccugcaagagagccaacgugaacgacuucuucaacagacugaacuggcuggugaagagcgacggcaacgccuacccccugcagaaccugaccaaggugaacaacggcgacuacgccagacuguacaucuggggcgugcaccaccccagcaccgacaccgagcagaccaaccuguacaagaacaaccccggcagagugaccgugagcaccaagaccagccagaccagcguggugcccaacaucggcagcagacccugggugagaggccagagcggcagaaucagcuucuacuggaccaucguggagcccggcgaccugaucguguucaacaccaucggcaaccugaucgcccccagaggccacuacaagcugaacagccagaagaagagcaccauccugaacaccgccacccccaucggcagcugcgugagcaagugccacaccgacaagggcagccugagcaccaccaagcccuuccagaacaucagcagaguggccaucggcgacugccccaaguacgugaagcagggcagccugaagcuggccaccggcaugagaaacauccccgagaaggccagcagaggccuguucggcgccaucgccggcuucaucgagaacggcuggcagggccugaucgacggcugguacggcuucagacaccagaacgccgagggcaccggcaccgccgccgaccugaagagcacccaggccgccaucgaccagaucaacggcaagcugaacagacugaucgagaagaccaacgagaaguaccaccagaucgagaaggaguucgagcagguggagggcagaauccaggaccuggagaaguacguggaggacaccaagaucgaccuguggagcuacaacgccgagcugcugguggcccuggagaaccagcacaccaucgacgugaccgacagcgagaugaacaagcuguucgagagagugagaagacagcugagagagaacgccgaggacaagggcaacggcugcuucgagaucuuccacaagugcgacaacaacugcaucgagagcaucagaaacggcaccuacgaccacgacguguacagaaacgaggccaucaacaacagauuccagauccagggcgugaagcugacccagggcuacaaggacaucauccuguggaucagcuucagcaucagcugcuuccugcugguggcccugcugcuggccuucauccugugggccugccagaacggcaacaucagaugccagaucugcaucuga

SEQ ID NO: 162700 - RNA, 1683 nt, Artificial Sequence
  derived and/or modified sequence opt4 from hemagglutinin__InfluenzaA__AGQ80953
augaacacccagauccugguguucgcccugguggccaucauccccaccaacgccgacaagaucugccugggccaccacgccgugagcaacggcaccaaggugaacacccugaccgagagaggcguggagguggugaacgccaccgagaccguggagagaaccagcauccccagaaucugcagcaagggcaagagagccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggagaccaugggcuucaccuacagcggcaucagaaccaacggcgccaccagcgccugcagaagaagcggcagcagcuucuacgccgagaugaaguggcugcugagcaacaccgacaacgccgccuucccccagaccaccaagagcuacaagaacaccagaaaggaccccgcccugaucaucuggggcauccaccacagcggcagcaccaccgagcagaccaagcuguacggcagcggcaacaagcugaucaccgugggcagcagcaacuaccagcagagcuucgugcccagccccggcgccagaccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacaacggcggcaccaucaucagcaaccugcccuuccagaacaucaacagcagagccgugggcaagugccccagauacgugaagcaggagagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaccgagguggagagacagaucggcaacgugaucaacuggaccagagacagcaugaccgagguguggagcuacaacgccgagcugcugguggccauggagaaccagcacaccaucgaccuggccgacagcgagaugaacaagcuguacgagagagugagaagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162701 - RNA, 1683 nt, Artificial Sequence; identical to SEQ ID NO: 162700
  derived and/or modified sequence opt4 from hemagglutinin__InfluenzaA__AGQ80954

SEQ ID NO: 162702 - RNA, 1683 nt, Artificial Sequence; identical to SEQ ID NO: 162700
  derived and/or modified sequence opt4 from hemagglutinin__InfluenzaA__AGQ80955

SEQ ID NO: 162703 - RNA, 1683 nt, Artificial Sequence; identical to SEQ ID NO: 162700
  derived and/or modified sequence opt4 from hemagglutinin__InfluenzaA__AGQ80956

SEQ ID NO: 162704 - RNA, 1683 nt, Artificial Sequence; identical to SEQ ID NO: 162700
  derived and/or modified sequence opt4 from hemagglutinin__InfluenzaA__AGQ80957

SEQ ID NO: 162705 - RNA, 1683 nt, Artificial Sequence; identical to SEQ ID NO: 162700
  derived and/or modified sequence opt4 from hemagglutinin__InfluenzaA__AGQ80958

SEQ ID NO: 162706 - RNA, 1683 nt, Artificial Sequence
  derived and/or modified sequence opt4 from hemagglutinin__InfluenzaA__AGQ80959
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgccaccagcgccugcagaagaagcggcagcagcuucuacgccgagaugaaguggcugcugagcaacaccgacaacgccgccuucccccagaugaccaagagcuacaagaacaccagaaaggaccccgcccugaucaucuggggcauccaccacagcggcagcaccgccgagcagaccaagcuguacggcagcggcaacaagcuggugaccgugggcagcagcaacuaccagcagagcuucgugcccagccccggcgccagaccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacggcggcggcaccaucaucagcaaccugcccuuccagaacaucgacagcagagccgugggcaagugccccagauacgugaagcagaagagccugcugcuggccaccggcaugaagaacgugcccgagagccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaccgagguggagaagcagaucggcaacgugaucaacuggaccagagacagcaucaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162707 - RNA, 1683 nt, Artificial Sequence
  derived and/or modified sequence opt4 from hemagglutinin__InfluenzaA__AGQ80961
augaacacccagauccugguguucgcccugguggccaucauccccaccaacgccgacaagaucugccugggccaccacgccgugagcaacggcaccaaggugaacacccugaccgagagaggcguggagguggugaacgccaccgagaccguggagagaaccaacgugcccaagaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggagacccugagacagauccugagagagagcggcggcaucgacaaggagaccaugggcuucaccuacagcggcaucagaaccaacggcgccaccagcgccugcagaagaagcggcagcagcuucuacgccgagaugaaguggcugcugagcaacaccgacaacgccgccuucccccagaugaccaagagcuacaagaacgccagaaaggaccccgcccugaucaucuggggcauccaccacagcggcagcaccaccgagcagaccaagcuguacggcagcggcaacaagcugaucaccgugggcagcagcaacuaccagcagagcuucgugcccagccccggcgccagaccccaggugaacggccagagcggcagaaucgacuuccacuggcugaugcugaaccccaacgacaccgugaccuucagcuucaacggcgccuucaucgcccccgacagagccugcuuccugagaggcaagagcaugggcauccagagcggcgugcagguggacgccagcugcgagggcgacugcuaccacagcggcggcaccaucaucagcaaccugcccuuccagaacaucaacagcagagccgugggcaagugccccagauacgugaagcaggagagccugaugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaccgagguggagaagcagaucggcaacgugaucaacuggaccagagacagcaugaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaaucaagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162708 - RNA, 1683 nt, Artificial Sequence; identical to SEQ ID NO: 162707
  derived and/or modified sequence opt4 from hemagglutinin__InfluenzaA__AGQ80962

SEQ ID NO: 162709 - RNA, 1683 nt, Artificial Sequence
  derived and/or modified sequence opt4 from hemagglutinin__InfluenzaA__AGQ80964
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgccaccagcgccugcagaagaagcggcagcagcuucuacgccgagaugaaguggcugcugagcaacaccgacaacgccgccuucccccagaugaccaagagcuacaagaacaccagaaaggaccccgcccugaucaucuggggcauccaccacagcggcagcaccgccgagcagaccaagcuguacggcagcggcaacaagcuggugaccgugggcagcagcaacuaccagcagagcuucgugcccagccccggcgccagaccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccgacugcgagggcgacugcuaccacagcggcggcaccaucaucagcaaccugcccuuccagaacaucgacagcagagccgugggcaagugccccagauacgugaagcagagaagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaccgagguggagaagcagaucggcaacgugaucaacuggaccagagacagcaucaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162710 - RNA, 1683 nt, Artificial Sequence; identical to SEQ ID NO: 162700
  derived and/or modified sequence opt4 from hemagglutinin__InfluenzaA__AGQ80965

SEQ ID NO: 162711 - RNA, 1683 nt, Artificial Sequence; identical to SEQ ID NO: 162700
  derived and/or modified sequence opt4 from hemagglutinin__InfluenzaA__AGQ80966

SEQ ID NO: 162712 - RNA, 1683 nt, Artificial Sequence; identical to SEQ ID NO: 162700
  derived and/or modified sequence opt4 from hemagglutinin__InfluenzaA__AGQ80968

SEQ ID NO: 162713 - RNA, 1683 nt, Artificial Sequence
  derived and/or modified sequence opt4 from hemagglutinin__InfluenzaA__AGQ80970
augaacacccagauccugguguucgcccugguggccaucauccccaccaacgccgacaagaucugccugggccaccacgccgugagcaacggcaccaaggugaacacccugaccgagagaggcguggagguggugaacgccaccgagaccguggagagaaccagcauccccagaaucugcagcaagggcaagaaggccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggagaccaugggcuucaccuacagcggcaucagaaccaacggcgccaccagcgccugcagaagaagcggcagcagcuucuacgccgagaugaaguggcugcugagcaacaccgacaacgccgccuucccccagaccaccaagagcuacaagaacaccagaaaggaccccgcccugaucaucuggggcauccaccacagcggcagcaccaccgagcagaccaagcuguacggcagcggcaacaagcugaucaccgugggcagcagcaacuaccagcagagcuucgugcccagccccggcgccagaccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacaacggcggcaccaucaucagcaaccugcccuuccagaacaucaacagcagagccgugggcaagugccccagauacgugaagcaggagagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaccgagguggagagacagaucggcaacgugaucaacuggaccagagacagcaugaccgagguguggagcuacaacgccgagcugcugguggccauggagaaccagcacaccaucgaccuggccgacagcgagaugaacaagcuguacgagagagugagaagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162714 - RNA, 1683 nt, Artificial Sequence
  derived and/or modified sequence opt4 from hemagglutinin__InfluenzaA__AGQ80971
augaacacccagauccugguguucgcccugguggccaucauccccaccaacgccgacaagaucugccugggccaccacgccgugagcaacggcaccaaggugaacacccugaccgagagaggcguggagguggugaacgccaccgagaccguggagagaaccagcauccccagaaucugcagcaagggcaagaagaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggagaccaugggcuucaccuacagcggcaucagaaccaacggcgccaccagcgccugcagaagaagcggcagcagcuucuacgccgagaugaaguggcugcugagcaacaccgacaacgccgccuucccccagaccaccaagagcuacaagaacaccagaaaggaccccgcccugaucaucuggggcauccaccacagcggcagcaccaccgagcagaccaagcuguacggcagcggcaacaagcugaucaccgugggcagcagcaacuaccagcagagcuucgugcccagccccggcgccagaccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacaacggcggcaccaucaucagcaaccugcccuuccagaacaucaacagcagagccgugggcaagugccccagauacgugaagcaggagagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaccgagguggagagacagaucggcaacgugaucaacuggaccagagacagcaugaccgagguguggagcuacaacgccgagcugcugguggccauggagaaccagcacaccaucgaccuggccgacagcgagaugaacaagcuguacgagagagugagaagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162715 - RNA, 1683 nt, Artificial Sequence
  derived and/or modified sequence opt4 from hemagglutinin__InfluenzaA__AGQ80974
augaacacccagauccugguguucgcccugguggccaucauccccaccaacgccgacaagaucugccugggccaccacgccgugagcaacggcaccaaggugaacacccugaccgagagaggcguggagguggugaacgccaccgagaccguggagagaaccagcauccccagaaucugcagcaagggcaagagagccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggagaccaugggcuucaccuacagcggcaucagaaccaacggcgccaccagcgccugcagaagaagcggcagcagcuucuacgccgagaugaaguggcugcugagcaacaccgacaacgccgccuucccccagaccaccaagagcuacaagaacaccagaaaggaccccgcccugaucaucuggggcauccaccacagcggcagcaccaccgagcagaccaagcuguacggcagcggcaacaagcugaucaccgugggcagcagcaacuaccagcagagcuucgugcccagccccggcgccagaccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacaacggcggcaccaucaucagcaaccugcccuuccagaacaucaacagcagagccgugggcaagugccccagauacgugaagcaggagagccugcugcuggccaccggcaugaagaacgugcccgagauccccaagggcagaggccuguucggcgccaucgccggcuucaucgagaacggcugggagggccugguggacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaccgagguggagagacagaucggcaacgugaucaacuggaccagagacagcaugaccgagguguggagcuacaacgccgagcugcugguggccauggagaaccagcacaccaucgaccuggccgacagcgagaugaacaagcuguacgagagagugagaagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162716 - RNA, 1683 nt, Artificial Sequence
  derived and/or modified sequence opt4 from hemagglutinin__InfluenzaA__AGQ80977
augaacacccagauccuggcccuggcccuggccgccaucauccccaccaacgccgacaagaucugccugggccaccacgccgugagcaacggcaccaaggugaacacccugaccgagagaggcguggagguggugaacgccaccgagaccguggagagaaccagcauccccagaaucugcagcaagggcaagagagccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggagaccaugggcuucaccuacagcggcaucagaaccaacggcgccaccagcgccugcagaagaagcggcagcagcuucuacgccgagaugaaguggcugcugagcaacaccgacaacgccgccuucccccagaccaccaagagcuacaagaacaccagaaaggaccccgcccugaucaucuggggcgugcaccacagcggcagcaccaccgagcagaccaagcuguacggcagcggcaacaagcugaucaccgugggcagcagcaacuaccagcagagcuucgugcccagccccggcgccagaccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacaacggcggcaccaucaucagcaaccugcccuuccagaacaucaacagcagagccgugggcaagugccccagauacgugaagcaggagagccugcugcuggccaccggcaugaagaacgugcccgagauccccaagggcagaggccuguucggcgccaucgccggcuucaucgagaacggcugggagggccugguggacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaccgagguggagagacagaucggcaacgugaucaacuggaccagagacagcaugaccgagguguggagcuacaacgccgagcugcugguggccauggagaaccagcacaccaucgaccuggccgacagcgagaugaacaagcuguacgagagagugagaagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagagcggcaacaugagaugcaccaucugcaucuga

SEQ ID NO: 162717 - RNA, 1683 nt, Artificial Sequence
  derived and/or modified sequence opt4 from hemagglutinin__InfluenzaA__AGQ80978
augaacacccagauccugguguucgcccugguggccaucauccccaccaacgccgacaagaucugccugggccaccacgccgugagcaacggcaccaaggugaacacccugaccgagagaggcguggagguggugaacgccaccgagaccguggagagaaccagcauccccagaaucugcagcaagggcaagagagccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggagaccaugggcuucaccuacagcggcaucagaaccaacggcgccaccagcgccugcagaagaagcggcagcagcuucuacgccgagaugaaguggcugcugagcaacaccgacaacgccgccuucccccagaccaccaagagcuacaagaacaccagaaaggaccccgcccugaucaucuggggcauccaccacagcggcagcaucaccgagcagaccaagcuguacggcagcggcaacaagcugaucaccgugggcagcagcaacuaccagcagagcuucgugcccagccccggcgccagaccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacaacggcggcaccaucaucagcaaccugcccuuccagaacaucaacagcagagccgugggcaagugccccagauacgugaagcaggagagccugcugcuggccaccggcaugaagaacgugcccgagauccccaagggcagaggccuguucggcgccaucgccggcuucaucgagaacggcugggagggccugguggacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaccgagguggagagacagaucggcaacgugaucaacuggaccagagacagcaugaccgagguguggagcuacaacgccgagcugcugguggccauggagaaccagcacaccaucgaccuggccgacagcgagaugaacaagcuguacgagagagugagaagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162718 - RNA, 1683 nt, Artificial Sequence
  derived and/or modified sequence opt4 from hemagglutinin__InfluenzaA__AGQ80979
augaacacccagauccugguguucgcccugguggccaucauccccaccaacgccgacaagaucugccugggccaccacgccgugagcaacggcaccaaggugaacacccugaccgagagaggcguggagguggugaacgccaccgagaccguggagagaaccagcauccccagaaucugcagcaagggcaagagagccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggagaccaugggcuucaccuacagcggcaucagaaccaacggcgccaccagcgccugcagaagaagcggcagcagcuucuacgccgagaugaaguggcugcugagcaacaccgacaacgccgccuucccccagaccaccaagagcuacaagaacaccagaaaggaccccgcccugaucaucuggggcauccaccacagcggcagcaccaccgagcagaccaagcuguacggcagcggcaacaagcugaucaccgugggcagcagcaacuaccagcagagcuucgugcccagccccggcgccagaccccaggugaacggccagagcggcagaaucgacuuccacuggcugaugcugaaccccaacgacaccgugaccuucagcuucaacggcgccuucaucgcccccgacagagccagcuuccugagaggcaagagcaucggcauccagagcggcgugcagguggacgccaacugcgagggcgacugcuaccacaacggcggcaccaucaucagcaaccugcccuuccagaacaucaacagcagagccgugggcaagugccccagauacgugaagcaggagagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaccgagguggagagacagaucggcaacgugaucaacuggaccagagacagcaugaccgagguguggagcuacaacgccgagcugcugguggccauggagaaccagcacaccaucgaccuggccgacagcgagaugaacaagcuguacgagagagugagaagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162719 - RNA, 1683 nt, Artificial Sequence; identical to SEQ ID NO: 162715
  derived and/or modified sequence opt4 from hemagglutinin__InfluenzaA__AGQ80980

SEQ ID NO: 162720 - RNA, 1683 nt, Artificial Sequence; identical to SEQ ID NO: 162700
  derived and/or modified sequence opt4 from hemagglutinin__InfluenzaA__AGQ80981

SEQ ID NO: 162721 - RNA, 1683 nt, Artificial Sequence; identical to SEQ ID NO: 162700
  derived and/or modified sequence opt4 from hemagglutinin__InfluenzaA__AGQ80982

SEQ ID NO: 162722 - RNA, 1683 nt, Artificial Sequence; identical to SEQ ID NO: 162700
  derived and/or modified sequence opt4 from hemagglutinin__InfluenzaA__AGQ80983

SEQ ID NO: 162723 - RNA, 1683 nt, Artificial Sequence; identical to SEQ ID NO: 162700
  derived and/or modified sequence opt4 from hemagglutinin__InfluenzaA__AGQ80984

SEQ ID NO: 162724 - RNA, 1683 nt, Artificial Sequence; identical to SEQ ID NO: 162700
  derived and/or modified sequence opt4 from hemagglutinin__InfluenzaA__AGQ80985

SEQ ID NO: 162725 - RNA, 1683 nt, Artificial Sequence; identical to SEQ ID NO: 162700
  derived and/or modified sequence opt4 from hemagglutinin__InfluenzaA__AGQ80986

SEQ ID NO: 162726 - RNA, 1683 nt, Artificial Sequence; identical to SEQ ID NO: 162700
  derived and/or modified sequence opt4 from hemagglutinin__InfluenzaA__AGQ80987

SEQ ID NO: 162727 - RNA, 1683 nt, Artificial Sequence; identical to SEQ ID NO: 162700
  derived and/or modified sequence opt4 from hemagglutinin__InfluenzaA__AGQ80988

SEQ ID NO: 162728 - RNA, 1683 nt, Artificial Sequence
  derived and/or modified sequence opt4 from hemagglutinin__InfluenzaA__AGQ80990
augaacacccagauccugguguucgcccugguggccaucauccccaccaacgccgacaagaucugccugggccaccacgccgugagcaacggcaccaaggugaacacccugaccgagagaggcguggagguggugaacgccaccgagaccguggagagaaccagcauccccaagaucugcagcaagggcaagagagccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggagaccaugggcuucaccuacagcggcaucagaaccaacggcgccaccagcgccugcagaagaagcggcagcagcuucuacgccgagaugaaguggcugcugagcaacaccgacaacgccgccuucccccagaccaccaagagcuacaagaacaccagaaaggaccccgcccugaucaucuggggcauccaccacagcggcagcaccaccgagcagaccaagcuguacggcagcggcaacaagcugaucaccgugggcagcagcaacuaccagcagagcuucgugcccagccccggcgccagaccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacaacggcggcaccaucaucagcaaccugcccuuccagaacaucaacagcagagccgugggcaagugccccagauacgugaagcaggagagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaccgagguggagagacagaucggcaacgugaucaacuggaccagagacagcaugaccgagguguggagcuacaacgccgagcugcugguggccauggagaaccagcacaccaucgaccuggccgacagcgagaugaacaagcuguacgagagagugagaagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162729 - RNA, 1683 nt, Artificial Sequence; identical to SEQ ID NO: 162714
  derived and/or modified sequence opt4 from hemagglutinin__InfluenzaA__AGQ80991

SEQ ID NO: 162730 - RNA, 1683 nt, Artificial Sequence
  derived and/or modified sequence opt4 from hemagglutinin__InfluenzaA__AGQ80992
augaacacccagauccugguguucgcccugguggccaucauccccaccaacgccgacaagaucugccugggccaccacgccgugagcaacggcaccaaggugaacacccugaccgagagaggcguggagguggugaacgccaccgagaccguggagagaaccaacgugcccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucaugaacgaggaggcccugagacagauccugagagagagcggcggcaucgacaaggagaccaugggcuucaccuacagcggcaucagaaccaacggcgccaccagcgccugcagaagaagcggcagcagcuucuacgccgagaugaaguggcugcugagcaacaccgacaacgccgccuucccccagaugaccaagagcuacaagaacaccagaaaggaccccgcccugaucaucuggggcauccaccacagcggcagcaccaccgagcagaccaagcuguacggcagcggcaacaagcugaucaccgugggcagcagcaacuaccagcagagcuucgugcccagccccggcgccagaccccaggugaacggccagagcggcagaaucgacuuccacuggcugaugcugaaccccaacgacaccgugaccuucagcuucaacggcgccuucaucgcccccgacagagccugcuuccugagaggcaagagcaugggcauccagagcggcgugcagguggacgccagcugcgagggcgacugcuaccacagcggcggcaccaucaucagcaaccugcccuuccagaacaucaacagcagagccgugggcaagugccccagauacgugaagcaggagagccugaugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaccgagguggagaagcagaucggcaacgugaucaacuggaccagagacagcaugaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162731 - RNA, 1683 nt, Artificial Sequence; identical to SEQ ID NO: 162700
  derived and/or modified sequence opt4 from hemagglutinin__InfluenzaA__AGQ80993

SEQ ID NO: 162732 - RNA, 1683 nt, Artificial Sequence; identical to SEQ ID NO: 162707
  derived and/or modified sequence opt4 from hemagglutinin__InfluenzaA__AGQ80994

SEQ ID NO: 162733 - RNA, 1683 nt, Artificial Sequence; identical to SEQ ID NO: 162709
  derived and/or modified sequence opt4 from hemagglutinin__InfluenzaA__AGQ80995

SEQ ID NO: 162734 - RNA, 1683 nt, Artificial Sequence; identical to SEQ ID NO: 162709
  derived and/or modified sequence opt4 from hemagglutinin__InfluenzaA__AGQ80996

SEQ ID NO: 162735 - RNA, 1683 nt, Artificial Sequence
  derived and/or modified sequence opt4 from hemagglutinin__InfluenzaA__AGQ80997
augaacacccagauccugguguucgcccugguggccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggagaccaugggcuucaccuacagcggcaucagaaccgacggcgccaccagcgccugcagaagaagcggcagcagcuucuacgccgagaugaaguggcugcugagcaacaccgacaacgccgccuucccccagaugaccaagagcuacaagaacaccagaaaggaccccgcccugaucaucuggggcauccaccacagcggcagcaccaccgagcagaccaagcuguacggcagcggcaacaagcugaucaccgugggcagcagcaacuaccagcagagcuucgugcccagccccggcgccagaccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucaacagcagagccgugggcaagugccccagauacgugaagcaggagagccugcugcuggccaccggcaugaagaacgugcccgagauccccaagggcagaggccuguucggcgccaucgccggcuucaucgagaacggcugggagggccugaucgacggcugguacggcuucagacaccagaacagccagggcgagggcaccgccgccgacuacaagagcacccagagcgccaucgaccagaucaccggcaagcugaacagacugaucgagaagaccaaccagcaguucgagcugaucgacaacgaguucaccgagguggagaagcagaucggcaacgugaucaacuggaccagagacagcaugaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162736 - RNA, 1683 nt, Artificial Sequence
  derived and/or modified sequence opt4 from hemagglutinin__InfluenzaA__AGQ81000
augaacacccagauccugguguucgcccugguggccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucggcaaggagaccaugggcuucaccuacagcggcaucagaaccaacggcgccaccagcgccugcagaagaagcggcagcagcuucuacgccgagaugaaguggcugcugagcaacaccgacaacgccgccuucccccagaugaccaagagcuacaagaacaccagaaaggaccccgcccugaucaucuggggcauccaccacagcggcagcaccaccgagcagaccaagcuguacggcagcggcaacaagcugaucaccgugggcagcagcaacuaccagaagagcuucgugcccagccccggcgccagaccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacaacggcggcaccaucaucagcaaccugcccuuccagaacaucaacagcagagccgugggcaagugccccagauacgugaagcaggagagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaccgagguggagaagcagaucggcaacgugaucaacuggaccagagacagcaugaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162737 - RNA, 1683 nt, Artificial Sequence
  derived and/or modified sequence opt4 from hemagglutinin__InfluenzaA__AGQ81001
augaacacccagauccugguguucgcccugguggccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggagaccaugggcuucaccuacagcggcaucagaaccaacggcgccaccagcgccugcagaagaagcggcagcagcuucuacgccgagaugaaguggcugcugagcaacaccgacaacgccgccuucccccagaugaccaagagcuacaagaacaccagaaaggaccccgcccugaucaucuggggcauccaccacagcggcagcaccaccgagcagaccaagcuguacggcagcggcaacaagcugaucaccgugggcaccagcaacuaccagcagagcuucgugcccagccccggcgccagaccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacaacggcggcaccaucaucagcaaccugcccuuccagaacaucaacagcagagccgugggcaagugccccagauacgugaagcaggagagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaccgagaucgagaagcagaucggcaacgugaucaacuggaccagagacagcaugaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162738 - RNA, 1683 nt, Artificial Sequence; identical to SEQ ID NO: 162715
  derived and/or modified sequence opt4 from hemagglutinin__InfluenzaA__AGQ81002

SEQ ID NO: 162739 - RNA, 1683 nt, Artificial Sequence; identical to SEQ ID NO: 162715
  derived and/or modified sequence opt4 from hemagglutinin__InfluenzaA__AGQ81003

SEQ ID NO: 162740 - RNA, 1683 nt, Artificial Sequence; identical to SEQ ID NO: 162715
  derived and/or modified sequence opt4 from hemagglutinin__InfluenzaA__AGQ81004

SEQ ID NO: 162741 - RNA, 1683 nt, Artificial Sequence; identical to SEQ ID NO: 162715
  derived and/or modified sequence opt4 from hemagglutinin__InfluenzaA__AGQ81005

SEQ ID NO: 162742 - RNA, 1683 nt, Artificial Sequence; identical to SEQ ID NO: 162715
  derived and/or modified sequence opt4 from hemagglutinin__InfluenzaA__AGQ81006

SEQ ID NO: 162743 - RNA, 1683 nt, Artificial Sequence; identical to SEQ ID NO: 162715
  derived and/or modified sequence opt4 from hemagglutinin__InfluenzaA__AGQ81007

SEQ ID NO: 162744 - RNA, 1683 nt, Artificial Sequence; identical to SEQ ID NO: 162715
  derived and/or modified sequence opt4 from hemagglutinin__InfluenzaA__AGQ81008

SEQ ID NO: 162745 - RNA, 1683 nt, Artificial Sequence
  derived and/or modified sequence opt4 from hemagglutinin__InfluenzaA__AGQ81009
augaacacccagauccugguguucgcccugguggccaucauccccaccaacgccgacaagaucugccugggccaccacgccgugagcaacggcaccaaggugaacacccugaccgagagaggcguggagguggugaacgccaccgagaccguggagagaaccagcauccccagaaucugcagcaagggcaagagagccguggaccugggccagugcggccugcugggcaccaucaccggccccccccagugcgaccaguuccuggaguucagcgccgaccugaucaucgagagacaggagggcagcgacgugugcuaccccggcaaguucgugaacgaggaggcccugagacagauccugagagagagcggcggcaucaacaaggagaccaugggcuucaccuacagcggcaucagaaccaacggcgccaccagcgccugcagaagaagcggcagcagcuucuacgccgagaugaaguggcugcugagcaacaccgacaacgccgccuucccccagaccaccaagagcuacaagaacaccagaaaggaccccgcccugaucaucuggggcauccaccacagcggcagcaccaccgagcagaccaagcuguacggcagcggcaacaagcugaucaccgugggcagcagcaacuaccagcagagcuucgugcccagccccggcgccagaccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacaacggcggcaccaucaucagcaaccugcccuuccagaacaucaacagcagagccgugggcaagugccccagauacgugaagcaggagagccugcugcuggccaccggcaugaagaacgugcccgagauccccaagggcagaggccuguucggcgccaucgccggcuucaucgagaacggcugggagggccugguggacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaccgagguggagagacagaucggcaacgugaucaacuggaccagagacagcaugaccgagguguggagcuacaacgccgagcugcugguggccauggagaaccagcacaccaucgaccuggccgacagcgagaugaacaagcuguacgagagagugagaagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162746 - RNA, 1683 nt, Artificial Sequence
  derived and/or modified sequence opt4 from hemagglutinin__InfluenzaA__AGQ81011
augaacacccagauccugguguucgcccugaucgccaucacccccaccaacagcgacaagaucugccugggccaccacgccgugagcaacggcaccaaggugaacacccugaccgagagaggcguggagguggugaacgccaccgagaccguggagagaaccagcauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgccaccagcgccugcagaagaagcgagagcagcuucuacgccgagaugaaguggcugcugagcaacaccgacaacgccgccuucccccccaugaccaagagcuacaagaacaccagaaaggcccccgcccugaucaucuggggcauccaccacagcggcagcaccgccgagcagaccaagcuguacggcagcggcaacaagcuggugaccgugagaagcagcaacuaccagcagagcuucgugcccagccccggcgccggccccaaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagaguggugggcaagugccccagauacgugaagcagaagagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucaaccagaugaccggcaagcugaacagacugaucgagaagaccaaccagcaguucgagcugaucgacaacgaguucaccgagguggagaagcagaucggcaacgugaucaacuggaccagagacagcaucaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugccugauccugcuggccaucgccaugggccugguguucaucugcgugaagaacggcaacaugagaugcaccaucugcaucuga

SEQ ID NO: 162747 - RNA, 1683 nt, Artificial Sequence
  derived and/or modified sequence opt4 from hemagglutinin__InfluenzaA__AGQ81012
augaacacccagauccugguguucgcccugaucgccaucauccccaccaacagcgacaagaucugccugggccaccacgccgugagcaacggcaccaaggugaacacccugaccgagagaggcguggagguggugaacgccaccgagaccguggagagaaccagcauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucaacaaggaggccaugggcuucaccuacagcggcaucagaaccaacggcgccaccagcgccugcagaagaagcggcagcagcuucuacgccgagaugaaguggcugcugagcaacaccgacaacgccgccuucccccccaugaccaagagcuacaagaacaccagaaaggcccccgcccugaucaucuggggcauccaccacagcggcagcaccgccgagcagaccaagcuguacggcagcggcaacaagcuggugaccgugagaagcagcaacuaccagcagagcuucgugcccagccccggcgccggcccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagaguggugggcaagugccccagauacgugaagcagaagagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucaaccagaugaccggcaagcugaacagacugaucgagaagaccaaccagcaguucgagcugaucgacaacgaguucaccgagguggagaagcagaucggcaacgugaucaacuggaccagagacagcaucaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162748 - RNA, 1683 nt, Artificial Sequence
  derived and/or modified sequence opt4 from hemagglutinin__InfluenzaA__AGQ81017
augaacacccagauccugguguucgcccugaucgccaucacccccaccaacagcgacaagaucugccugggccaccacgccgugagcaacggcaccaaggugaacacccugaccgagagaggcguggagguggugaacgccaccgagaccguggagagaaccagcauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgccaccagcgccugcagaagaagcggcagcagcuucuacgccgagaugaaguggcugcugagcaacaccgacaacgccgccuucccccccaugaccaagagcuacaagaacaccagaaaggcccccgcccugaucaucuggggcauccaccacagcggcagcaccgccgagcagaccaagcuguacggcagcggcaacaagcuggugaccgugagaagcagcaacuaccagcagagcuucgugcccagccccggcgccggcccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagaguggugggcaagugccccagauacgugaagcagaagagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucaaccagaugaccggcaagcugaacagacugaucgagaagaccaaccagcaguucgagcugaucgacaacgaguucaccgagguggagaagcagaucggcaacgugaucaacuggaccagagacagcaucaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162749 - RNA, 1683 nt, Artificial Sequence
  derived and/or modified sequence opt4 from hemagglutinin__InfluenzaA__AGQ81018
augaacacccagauccugguguucgcccugaucgccaucauccccaccaacagcgacaagaucugccugggccaccacgccgugagcaacggcaccaaggugaacacccugaccgagagaggcguggagguggugaacgccaccgagaccguggagagaaccagcauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgugaaggaggccaugggcuucaccuacagcggcaucagaaccaacggcgccaccagcgccugcagaagaagcggcagcagcuucuacgccgagaugaaguggcugcugagcaacaccgacaacgccgccuucccccccaugaccaagagcuacaagaacaccagaaaggcccccgccaucaucaucuggggcauccaccacagcggcagcaccgccgagcagaccaagcuguacggcagcggcaacaagcuggugaccgugagaagcagcaacuaccagcagagcuucgugcccagccccggcgccggcccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcagaggcaccaucaucagcaaccugcccuuccagaacaucgacagcagaguggugggcaagugccccagauacgugaagcagaagagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucaaccagaugaccggcaagcugaacagacugaucgagaagaccaaccagcaguucgagcugaucgacaacgaguucaccgagguggagaagcagaucggcaacgugaucaacuggaccagagacagcaucaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162750 - RNA, 1683 nt, Artificial Sequence; identical to SEQ ID NO: 162749
  derived and/or modified sequence opt4 from hemagglutinin__InfluenzaA__AGQ81019

SEQ ID NO: 162751 - RNA, 1683 nt, Artificial Sequence; identical to SEQ ID NO: 162748
  derived and/or modified sequence opt4 from hemagglutinin__InfluenzaA__AGQ81020

SEQ ID NO: 162752 - RNA, 1683 nt, Artificial Sequence; identical to SEQ ID NO: 162749
  derived and/or modified sequence opt4 from hemagglutinin__InfluenzaA__AGQ81021

SEQ ID NO: 162753 - RNA, 1683 nt, Artificial Sequence; identical to SEQ ID NO: 162748
  derived and/or modified sequence opt4 from hemagglutinin__InfluenzaA__AGQ81022

SEQ ID NO: 162754 - RNA, 1683 nt, Artificial Sequence; identical to SEQ ID NO: 162749
  derived and/or modified sequence opt4 from hemagglutinin__InfluenzaA__AGQ81023

SEQ ID NO: 162755 - RNA, 1683 nt, Artificial Sequence
  derived and/or modified sequence opt4 from hemagglutinin__InfluenzaA__AGQ81025
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccagcauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgugaccagcgccugcagaagaagcggcagcagcuucuacgccgagaugaaguggcugcugagcaacaccgacaacgccgccuucccccccaugaccaagagcuacaagaacaccagaaaggcccccgcccugaucaucuggggcauccaccacagcggcagcaccgccgagcagaccaagcuguacggcagcggcaacaagcuggugaccgugagaagcagcaacuaccagcagagcuucgugcccagccccggcgccggcccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagaguggugggcaagugccccagauacgugaagcagaagagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucaaccagaugaccggcaagcugaacagacugaucgagaagaccaaccagcaguucggccugaucgacaacgaguucaccgagguggagaagcagaucggcaacgugaucaacuggaccagagacagcaucaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguggugaucugcgugaagaacggcaacaugagaugcaccaucugcaucuga

SEQ ID NO: 162756 - RNA, 1683 nt, Artificial Sequence
  derived and/or modified sequence opt4 from hemagglutinin__InfluenzaA__AGQ81026
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccagcauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgccaccagcgccugcagaagaagcggcagcagcuucuacgccgagaugaaguggcugcugagcaacaccgacaacgccgccuucccccccaccaccaagagcuacaagaacaccagaaaggcccccgcccugaucaucuggggcauccaccacagcggcagcaccgccgagcagaccaagcuguacggcagcggcaacaagcuggugaccgugagaagcagcaacuaccagcagagcuucgugcccagccccggcgccggcccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagaguggugggcaagugccccagauacgugaagcagaagagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucaaccagaugaccggcaagcugaacagacugaucgagaagaccaaccagcaguucgagcugaucgacaacgaguucaccgagguggagaagcagaucggcaacgugaucaacuggaccagagacagcaucaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162757 - RNA, 1683 nt, Artificial Sequence
  derived and/or modified sequence opt4 from hemagglutinin__InfluenzaA__AGQ81027
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccagcauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgugaccagcgccugcagaagaagcggcagcagcuucuacgccgagaugaaguggcugcugagcaacaccgacaacgccgccuucccccccaugaccaagagcuacaagaacaccagaaaggcccccgcccugaucaucuggggcauccaccacagcggcagcaccgccgagcagaccaagcuguacggcagcggcaacaagcuggugaccgugagaagcagcaacuaccagcagagcuucgugcccagccccggcgccggcccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagaguggugggcaagugccccagauacgugaagcagaagagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucaaccagaugaccggcaagcugaacagacugaucgagaagaccaaccagcaguucgagcugaucgacaacgaguucaccgagguggagaagcagaucggcaacgugaucaacuggaccagagacagcaucaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162758 - RNA, 1683 nt, Artificial Sequence
  derived and/or modified sequence opt4 from hemagglutinin__InfluenzaA__AGQ81028
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccagcauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgccaccagcgccugcagaagaagcggcagcagcuucuacgccgagaugaaguggcugcugagcaacaccgacaacgccgccuucccccccaccaccaagagcuacaagaacaccagaaaggcccccgcccugaucaucuggggcauccaccacagcggcagcaccgccgagcagaccaagcuguacggcagcggcaacaagcuggugaccgugagaagcagcaacuaccagcagagcuucgugcccagccccggcgccggcccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagaguggugggcaagugccccagauacgugaagcagaagagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucaaccagaugaccggcaagcugaacagacugaucgagaagaccaaccagcaguucgagcugaucgacaacgaguucaccgagguggagaagcagaucggcaacgugaucaacuggaccagagacagcaucaccgagauguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162759 - RNA, 1683 nt, Artificial Sequence
  derived and/or modified sequence opt4 from hemagglutinin__InfluenzaA__AGQ81029
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccagcauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgugaccagcgccugcagaagaagcggcagcagcuucuacgccgagaugaaguggcugcugagcaacaccgacaacgccgccuucccccccaugaccaagagcuacaagaacaccagaaaggcccccgcccugaucaucuggggcauccaccacagcggcagcaccgccgagcagaccaagcuguacggcagcggcaacaagcuggugaccgugagaagcagcaacuaccagcagagcuucaugcccagccccggcgccggcccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagaguggugggcaagugccccagauacgugaagcagaagagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucaaccagaugaccggcaagcugaacagacugaucgagaagaccaaccagcaguucgagcugaucgacaacgaguucaccgagguggagaagcagaucggcaacgugaucaacuggaccagagacagcaucaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162760 - RNA, 1683 nt, Artificial Sequence
  derived and/or modified sequence opt4 from hemagglutinin__InfluenzaA__AGQ81031
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccagcauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucaacaaggaggccaugggcuucaccuacagcggcaucagaaccaacggcgccaccagcgccugcagaagaagcggcagcagcuucuacgccgagaugaaguggcugcugagcaacaccgacaacgccgccuucccccccaugaccaagagcuacaagaacaccagaaaggcccccgcccugaucaucuggggcauccaccacagcggcagcaccgccgagcagaccaagcuguacggcagcggcaacaagauggugaccgugagaagcagcaacuaccagcagagcuucgugcccagccccggcgccggcccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagaguggugggcaagugccccagauacgugaagcagaagagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucaaccagaugaccggcaagcugaacagacugaucgagaagaccaaccagcaguucgagcugaucgacaacgaguucaccgagguggagagacagaucggcaacgugaucaacuggaccagagacagcaucaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162761 - RNA, 1683 nt, Artificial Sequence; identical to SEQ ID NO: 162756
  derived and/or modified sequence opt4 from hemagglutinin__InfluenzaA__AGQ81032

SEQ ID NO: 162762 - RNA, 1683 nt, Artificial Sequence; identical to SEQ ID NO: 162757
  derived and/or modified sequence opt4 from hemagglutinin__InfluenzaA__AGQ81033

SEQ ID NO: 162763 - RNA, 1683 nt, Artificial Sequence; identical to SEQ ID NO: 162756
  derived and/or modified sequence opt4 from hemagglutinin__InfluenzaA__AGQ81034

SEQ ID NO: 162764 - RNA, 1683 nt, Artificial Sequence; identical to SEQ ID NO: 162757
  derived and/or modified sequence opt4 from hemagglutinin__InfluenzaA__AGQ81035

SEQ ID NO: 162765 - RNA, 1683 nt, Artificial Sequence; identical to SEQ ID NO: 162757
  derived and/or modified sequence opt4 from hemagglutinin__InfluenzaA__AGQ81036

SEQ ID NO: 162766 - RNA, 1683 nt, Artificial Sequence; identical to SEQ ID NO: 162757
  derived and/or modified sequence opt4 from hemagglutinin__InfluenzaA__AGQ81037

SEQ ID NO: 162767 - RNA, 1683 nt, Artificial Sequence; identical to SEQ ID NO: 162749
  derived and/or modified sequence opt4 from hemagglutinin__InfluenzaA__AGQ81038

SEQ ID NO: 162768 - RNA, 1683 nt, Artificial Sequence; identical to SEQ ID NO: 162749
  derived and/or modified sequence opt4 from hemagglutinin__InfluenzaA__AGQ81039

SEQ ID NO: 162769 - RNA, 1683 nt, Artificial Sequence
  derived and/or modified sequence opt4 from hemagglutinin__InfluenzaA__AGQ81040
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgccaccagcgccugcagaagaagcggcagcagcuucuacgccgagaugaaguggcugcugagcaacaccgacaacgccgccuucccccagaugaccaagagcuacaagaacaccagaaaggaccccgcccugaucaucuggggcauccaccacagcggcagcaccgccgagcagaccaagcuguacggcagcggcaacaagcuggugaccgugggcagcagcaacuaccagcagagcuucgugcccagccccggcgccagaccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagaucgacgccaacugcgagggcgacugcuaccacagcggcggcaccaucaucagcaaccugcccuuccagaacaucgacagcagagccgugggcaagugccccagauacgugaagcagaagagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaccgagguggagaagcagaucggcaacgugaucaacuggaccagagacagcaucaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162770 - RNA, 1683 nt, Artificial Sequence
  derived and/or modified sequence opt4 from hemagglutinin__InfluenzaA__AGQ81041
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgccaccagcgccugcagaagaagcggcagcagcuucuacgccgagaugaaguggcugcugagcaacaccgacaacgccgccuucccccagaccaccaagagcuacaagaacaccagaaaggaccccgcccugaucaucuggggcauccaccacagcggcagcaccgccgagcagaccaagcuguacggcagcggcaacaagcuggugaccgugggcagcagcaacuaccagcagagcuucgugcccagccccggcgccagaccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagagccgugggcaagugccccagauacgugaagcagaagagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaccgagguggagaagcagaucggcaacgugaucaacuggaccagagacagcaucaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162771 - RNA, 1683 nt, Artificial Sequence
  derived and/or modified sequence opt4 from hemagglutinin__InfluenzaA__AGQ81042
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgccaccagcgccugcagaagaagcggcagcagcuucuacgccgagaugaaguggcugcugagcaacaccgacaacgccgccuucccccagaugaccaagagcuacaagaacaccagaaaggaccccgcccugaucaucuggggcauccaccacagcggcagcaccgccgagcagaccaagcuguacggcagcggcaacaagcuggugaccgugggcagcagcaacuaccagcagagcuucgugcccagccccggcgccagaccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagagccgugggcaagugccccagauacgugaagcagaagagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaccgagguggagaagcagaucggcaacgugaucaacuggaccagagacagcaucaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162772 - RNA, 1683 nt, Artificial Sequence
  derived and/or modified sequence opt4 from hemagglutinin__InfluenzaA__AGQ81043
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggagaugggcuucaccuacagcggcaucagaaccaacggcgccaccagcgccugcagaagaagcggcagcagcuucuacgccgagaugaaguggcugcugagcaacaccgacaacgccgccuucccccagaugaccaagagcuacaagaacaccagaaagagccccgcccugaucguguggggcauccaccacagcgugagcaccgccgagcagaccaagcuguacggcagcggcaacaagcuggugaccgugggcagcagcaacuaccagcagagcuucgugcccagccccggcgccagaccccaggugaacggccugagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagagccgugggcaagugccccagauacgugaagcagagaagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaacgagguggagaagcagaucggcaacgugaucaacuggaccagagacagcaucaccgagguguggagcuacaacgccgagcugcugguggccauggagaaccagcacaccaucgaccuggccgacagcgagauggacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgugaugggccugguguucaucugcgugaagaacggcaacaugagaugcaccaucugcaucuga

SEQ ID NO: 162773 - RNA, 1683 nt, Artificial Sequence; identical to SEQ ID NO: 162508
  derived and/or modified sequence opt4 from hemagglutinin__InfluenzaA__AGQ81044

SEQ ID NO: 162774 - RNA, 1683 nt, Artificial Sequence; identical to SEQ ID NO: 162508
  derived and/or modified sequence opt4 from hemagglutinin__InfluenzaA__AGQ81045

SEQ ID NO: 162775 - RNA, 1683 nt, Artificial Sequence; identical to SEQ ID NO: 162508
  derived and/or modified sequence opt4 from hemagglutinin__InfluenzaA__AGQ81046

SEQ ID NO: 162776 - RNA, 1683 nt, Artificial Sequence; identical to SEQ ID NO: 162757
  derived and/or modified sequence opt4 from hemagglutinin__InfluenzaA__AGQ81047

SEQ ID NO: 162777 - RNA, 1683 nt, Artificial Sequence; identical to SEQ ID NO: 162756
  derived and/or modified sequence opt4 from hemagglutinin__InfluenzaA__AGQ81049

SEQ ID NO: 162778 - RNA, 1683 nt, Artificial Sequence; identical to SEQ ID NO: 162757
  derived and/or modified sequence opt4 from hemagglutinin__InfluenzaA__AGQ81050

SEQ ID NO: 162779 - RNA, 1683 nt, Artificial Sequence
  derived and/or modified sequence opt4 from hemagglutinin__InfluenzaA__AGQ81051
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccagcauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucaacaaggaggccaugggcuucaccuacagcggcaucagaaccaacggcgccaccagcgccugcagaagaagcggcagcagcuucuacgccgagaugaaguggcugcugagcaacaccgacaacgccgccuucccccccaugaccaagagcuacaagaacaccagaaaggcccccgcccugaucaucuggggcauccaccacagcggcagcaccgccgagcagaccaagcuguacggcagcggcaacaagcuggugaccgugagaagcagcaacuaccagcagagcuucgugcccagccccggcgccggcccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagaguggugggcaagugccccagauacgugaagcagaagagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucaaccagaugaccggcaagcugaacagacugaucgagaagaccaaccagcaguucgagcugaucgacaacgaguucaccgagguggagaagcagaucggcaacgugaucaacuggaccagagacagcaucaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162780 - RNA, 1683 nt, Artificial Sequence; identical to SEQ ID NO: 162757
  derived and/or modified sequence opt4 from hemagglutinin__InfluenzaA__AGQ81052

SEQ ID NO: 162781 - RNA, 1683 nt, Artificial Sequence
  derived and/or modified sequence opt4 from hemagglutinin__InfluenzaA__AGQ81053
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccagcauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucaacaaggaggccaugggcuucaccuacagcggcaucagaaccaacggcgccaccagcgccugcagaagaagcggcagcagcuucuacgccgagaugaaguggcugcugagcaacaccgacaacgccgccuucccccccaugaccaagagcuacaagaacaccagaaaggcccccgcccugaucaucuggggcauccaccacagcggcagcaccgccgagcagaccaagcuguacggcagcggcaacaagauggugaccgugagaagcagcaacuaccagcagagcuucgugcccagccccggcgccggcccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagaguggugggcaagugccccagauacgugaagcagaagagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucaaccagaugaccggcaagcugaacagacugaucgagaagaccaaccagcaguucgagcugaucgacaacgaguucaccgagguggagaagcagaucggcaacgugaucaacuggaccagagacagcaucaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagaaaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162782 - RNA, 1683 nt, Artificial Sequence; identical to SEQ ID NO: 162757
  derived and/or modified sequence opt4 from hemagglutinin__InfluenzaA__AGQ81055

SEQ ID NO: 162783 - RNA, 1683 nt, Artificial Sequence; identical to SEQ ID NO: 162757
  derived and/or modified sequence opt4 from hemagglutinin__InfluenzaA__AGQ81056

SEQ ID NO: 162784 - RNA, 1683 nt, Artificial Sequence; identical to SEQ ID NO: 162757
  derived and/or modified sequence opt4 from hemagglutinin__InfluenzaA__AGQ81057

SEQ ID NO: 162785 - RNA, 1683 nt, Artificial Sequence; identical to SEQ ID NO: 162757
  derived and/or modified sequence opt4 from hemagglutinin__InfluenzaA__AGQ81058

SEQ ID NO: 162786 - RNA, 1683 nt, Artificial Sequence; identical to SEQ ID NO: 162508
  derived and/or modified sequence opt4 from hemagglutinin__InfluenzaA__AGQ81059

SEQ ID NO: 162787 - RNA, 1683 nt, Artificial Sequence; identical to SEQ ID NO: 162508
  derived and/or modified sequence opt4 from hemagglutinin__InfluenzaA__AGQ81060

SEQ ID NO: 162788 - RNA, 1683 nt, Artificial Sequence; identical to SEQ ID NO: 162508
  derived and/or modified sequence opt4 from hemagglutinin__InfluenzaA__AGQ81061

SEQ ID NO: 162789 - RNA, 1683 nt, Artificial Sequence
  derived and/or modified sequence opt4 from hemagglutinin__InfluenzaA__AGQ81081
auggagguggugagccugaucaccauccugcuggugaucaccggcagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggcagaccccugauccuggacaccugcaccaucgagggccugaucuacggcaaccccagcugcgacauccugcugggcggcagagaguggagcuacaucguggagagacccagcgccgugaacggccugugcuaccccggcaacguggagaaccuggaggagcugagaagccuguucagcagcgccagcagcuaccagagaauccagaucuuccccgacaccaucuggaacgugagcuacagcggcaccagcaaggccugcagcgacagcuucuacagaagcaugagauggcugacccagaagaacaacgccuaccccgugcaggacgcccaguacaccaacaacagaggcagaaacauccuguucauguggggcaucaaccacccccccaccgacaccgcccagaccaaccuguacaccagaaccgacaccaccaccagcguggccaccgaggacaucaacagaaccuucaagccccugaucggccccagaccccuggugaacggccugcagggcagaaucgacuacuacugggccgugcugagacccggccagacccugagaaucagaagcaacggcaaccugaucgcccccugguacggccacauccugagcggcgagagccacggcagaauccugaagaccgaccugaacagcggcaacugcguggugcagugccagaccgagagaggcggccugaacaccacccugcccuuccacaacgugagcaaguacgccuucggcaacugccccaaguacgugggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgagaucaucgaccacgaguucagcgagaucgagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacaaccagugcauggagaccaucagaaacggcaccuacaacagaagaaaguacaaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162790 - RNA, 1683 nt, Artificial Sequence
  derived and/or modified sequence opt4 from hemagglutinin__InfluenzaA__AGQ81086
auggagguggugagccugaucaccauccugcuggugaucaccggcagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggcagaccccugauccuggacaccugcaccaucgagggccugaucuacggcaaccccagcugcgaccugcugcugggcggcagagaguggagcuacaucguggagagacccagcgccgugaacggccugugcuaccccggcaacguggagaaccuggaggagcugagaagccuguucagcagcgccagcagcuaccagagaauccagaucuuccccgacaccaucuggaacgugagcuacagcggcaccagcaaggccugcagcgacagcuucuacagaagcaugagauggcugacccagaagaacaacgccuaccccgugcaggacgcccaguacaccaacaacagaggcagaaacauccuguucauguggggcaucaaccacccccccaccgacaccgcccagaccaaccuguacaccagaaccgacaccaccaccagcguggccaccgaggacaucaacagaaccuucaagccccugaucggccccagaccccuggugaacggccugcagggcagaaucgacuacuacugggccgugcugagacccggccagacccugagaaucagaagcaacggcaaccugaucgcccccugguacggccacauccugagcggcgagagccacggcagaauccugaagaccgaccugaacagcggcaacugcguggugcagugccagaccgagagaggcggccugaacaccacccugcccuuccacaacgugagcaaguacgccuucggcaacugccccaaguacgugggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgagaucaucgaccacgaguucagcgagaucgagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacaaccagugcauggagaccaucagaaacggcaccuacaacagaagaaaguacaaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162791 - RNA, 1683 nt, Artificial Sequence
  derived and/or modified sequence opt4 from hemagglutinin__InfluenzaA__AGQ81087
auggagaccgugagccugaucaccaugcugcugguggccaccgugaucaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggccacccccugauccuggacaccugcaccaucgagggccugaucuacggcaaccccagcugcgaccugcugcugggcggcagagaguggagcuacaucguggagagacccagcgccgugaacggccugugcuaccccggcaacguggagaaccuggaggagcugagaagccuguucagcagcgccagcagcuaccagagaauccagaucuuccccgacaccaucuggaacgugagcuacagcggcaccagcaaggccugcagcgacagcuucuacagaagcaugagauggcugacccagaagaacaacgccuaccccauccaggacgcccaguacaccaacaacagagagaagaacauccuguucauguggggcaucaaccacccccccaccgacaccgcccagaccaaccuguacaccagaaccgacaccaccaccagcguggccaccgaggagaucaacagaaccuucaagccccugaucggccccagaccccuggugaacggccugcagggcagaaucgacuacuacuggagcgugcugaagcccggccagacccugagaaucagaagcaacggcaaccugaucgcccccugguacggccacauccugagcggcgagagccacggcagagugcugaagaccgaccugaagagaggcagcugcaccgugcagugccagaccgagaagggcggccugaacaccacccugcccuuccagaacgugagcaaguacgccuucggcaacugcagcaaguacgugggcgugaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaugaccagcaaggugaacaacaucguggacaagaugaacaagcaguacgagaucaucaaccacgaguucagcgagaucgagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaagaagauaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162792 - RNA, 1683 nt, Artificial Sequence
  derived and/or modified sequence opt4 from hemagglutinin__InfluenzaA__AGQ81092
auggagguggugagccugaucaccauccugcuggugaucaccggcagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggcagaccccugauccuggacaccugcaccaucgagggccugaucuacggcaaccccagcugcgaccugcugcugggcggcagagaguggagcuacaucguggagagacccagcgccgugaacggccugugcuaccccggcaacguggagaaccuggaggagcugagaagccuguucagcagcgccagcagcuaccagagaauccagaucuuccccgacaccaucuggaacgugagcuacaccggcaccagcaaggccugcagcgacagcuucuacagaagcaugagauggcugacccagaagaacaacgccuaccccgugcaggacgcccaguacaccaacaacagaggcagaaacauccuguucauguggggcaucaaccacccccccaccgacaccacccagaccaaccuguacaccagaaccgacaccaccaccagcguggccaccgaggacaucaacagaaccuucaagccccugaucggccccagaccccuggugaacggccugcagggcagaaucgacuacuacugggccgugcugagacccggccagacccugagaaucagaagcaacggcaaccugaucgcccccugguacggccacauccugagcggcgagagccacggcagaauccugaagaccgaccugaagagcggcaacugcguggugcagugccagaccgagagaggcggccugaacaccacccugcccuuccacaacgugagcaaguacgccuucggcaacugccccaaguacgugggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgagaucaucgaccacgaguucagcgagaucgagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacaaccagugcauggagaccaucagaaacggcaccuacaacagaagaaaguacaaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162793 - RNA, 1683 nt, Artificial Sequence
  derived and/or modified sequence opt4 from hemagglutinin__InfluenzaA__AGQ81095
auggagguggugagccugaucaccauccugcuggugaucaccgugagcaacgccgacaagaucugcaucggcuaccagagcaccaacagcaccgagaccgugaacacccugaccgaggacaacgugcccgugacccacgccaaggagcugcugcacaccgagcacaacggcaugcugugcgccaccaaccugggcagaccccugauccuggacaccugcaccaucgagggccugaucuacggcaaccccagcugcgaccugcugcugggcggcagagaguggagcuacaucguggagagacccagcgccgugaacggccugugcuaccccggcaacguggagaaccuggaggagcugagaagccuguucagcagcgccagcagcuaccagagaauccagaucuuccccgacaccaucuggaacgugagcuacagcggcaccagcaaggccugcagcgacagcuucuacagaagcaugagauggcugacccagaagaacaacgccuaccccgugcaggacgcccaguacaccaacaacagaggcagaaacauccuguucauguggggcaucaaccacccccccaccgacaccgcccagaccaaccuguacaccagaaccgacaccaccaccagcguggccaccgaggacaucaacagaaccuucaagccccugaucggccccagaccccuggugaacggccugcagggcagaaucgacuacuacugggccgugcugaagcccggccagacccugagaaucagaagcaacggcaaccugaucgcccccugguacggccacauccugagcggcgagagccacggcagaauccugaagaccgaccugaacagcggcaacugcguggugcagugccagagcgagagaggcggccugaacaccacccugcccuuccacaacgugagcaaguacgccuucggcaacugccccaaguacgugggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgagaucaucgaccacgaguucagcgagaucgagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacaaccagugcauggagaccaucagaaacggcaccuacgacagaagaaaguacaaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaagaaacaucugcaucuga

SEQ ID NO: 162794 - RNA, 1683 nt, Artificial Sequence
  derived and/or modified sequence opt4 from hemagglutinin__InfluenzaA__AGQ81099
auggagaccgugagccugaucaccauccugcugaucgugaccgugagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggccacccccugauccuggacaccugcaccaucgagggccugaucuacggcaaccccagcugcgaccugcugcugggcggcagagaguggagcuacaucguggagagacccagcgccgugaacggccugugcuaccccggcaacguggagaaccuggaggagcugagaagccuguucagcagcgccaacagcuaccagagaauccagaucuuccccgacaccaucuggaacgugagcuacagcggcaccagcaaggccugcagcgacagcuucuacagaagcaugagauggcugacccagaagaacaacgccuaccccacccaggacgcccaguacaccaacaacagagagaagaacauccuguucauguggggcaucaaccacccccccaccgacaccgcccagaccaaccuguacaccagaaccgacaccaccaccagcguggccaccgaggagaucaacagaaccuucaagccccugaucggccccagaccccuggugaacggccugcagggcagaaucgacuacuacuggagcgugcugaagcccggccagacccugagaaucagaagcaacggcaaccugaucgcccccugguacggccacauccugagcggcgagagccacggcagaauccugaagaccgaccugaagagaggcagcugcaccgugcagugccagaccgagaagggcggccugaacaccacccugcccuuccagaacgugagcaaguacgccuucggcaacugcagcaaguacgugggcgugaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaaggugaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaagaaaguaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaagaaacaucugcaucuga

SEQ ID NO: 162795 - RNA, 1683 nt, Artificial Sequence
  derived and/or modified sequence opt4 from hemagglutinin__InfluenzaA__AGQ81100
auggagaccgugagccugaucaccaugcugcugguggccaccgugaucaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggccacccccugauccuggacaccugcaccaucgagggccugaucuacggcaaccccagcugcgaccugcugcugggcggcagagaguggagcuacaucguggagagacccagcgccgugaacggccugugcuaccccggcaacguggagaaccuggaggagcugagaagccuguucagcagcgccagcagcuaccagagaauccagaucuuccccgacaccaucuggaacgugagcuacagcggcaccagcaaggccugcagcgacagcuucuacagaagcaugagauggcugacccagaagaacaacgccuaccccauccaggacgcccaguacaccaacaacagagagaagaacauccuguucauguggggcaucaaccacccccccaccgacaccgcccagaccaaccuguacaccagaaccgacaccaccaccagcguggccaccgaggagaucaacagaaccuucaagccccugaucggccccagaccccuggugaacggccugcagggcagaaucgacuacuacuggagcgugcugaagcccggccagacccugagaaucagaagcaacggcaaccugaucgcccccugguacggccacauccugagcggcgagagccacggcagaauccugaagaccgaccugaagagaggcagcugcaccgugcagugccagaccgagaagggcggccugaacaccacccugcccuuccagaacgugagcaaguacgccuucggcaacugcagcaaguacgugggcgugaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaagaagauaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaagaaacaucugcaucuga

SEQ ID NO: 162796 - RNA, 1683 nt, Artificial Sequence
  derived and/or modified sequence opt4 from hemagglutinin__InfluenzaA__AGQ81123
auggagguggugagccugaucaccauccugcuggugaucaccgugagcaacgccgacaagaucugcaucggcuaccagagcaccaacagcaccgagaccgugaacacccugaccgaggacaacgugcccgugacccacgccaaggagcugcugcacaccgagcacaacggcaugcugugcgccaccaaccugggcagaccccugauccuggacaccugcaccaucgagggccugaucuacggcaaccccagcugcgaccugcugcugggcggcagagaguggagcuacaucguggagagacccagcgccgugaacggccugugcuaccccggcaacguggagaaccuggaggagcugagaagccuguucagcagcgccagcagcuaccagagaauccagaucuuccccgacaccaucuggaacgugagcuacagcggcaccagcaaggccugcagcgacagcuucuacagaagcaugagauggcugacccagaagaacaacgccuaccccgugcaggacgcccaguacaccaacaacaagggcagaaacauccuguucauguggggcaucaaccacccccccaccgacaccgcccagaccaaccuguacaccagaaccgacaccaccaccagcguggccaccgaggacaucaacagaaccuucaagccccugaucggccccagaccccuggugaacggccugcagggcagaaucgacuacuacugggccgugcugaagcccggccagacccugagaaucagaagcaacggcaaccugaucgcccccugguacggccacauccugcugggcgagagccacggcagaauccugaagaccgaccugaacagcggcgacugcguggugcagugccagagcgagagaggcggccugaacaccacccugcccuuccacaacgugagcaaguacgccuucggcaacugccccaaguacgugggcgugaagagccugaagcuggccgugggccugagaaacgugcccgccagaagcaccagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgagaucaucgaccacgaguucagcgagaucgagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacaaccagugcauggagaccaucagaaacggcaccuacgacagaagaaaguacaaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162797 - RNA, 1683 nt, Artificial Sequence
  derived and/or modified sequence opt4 from hemagglutinin__InfluenzaA__AGQ81124
auggagguggccacccugaucaccauccugcuggugaucaccggcagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggcagaccccugauccuggacaccugcaccaucgagggccugaucuacggcaaccccagcugcgaccugccccuggagggcagagaguggagcuacaucguggagagacccagcgccgugaacggcgugugcuaccccggcaacguggagaaccuggaggagcugagaagccuguucagcagcgccagcagcuaccagagaauccagaucuuccccgacagcaucuggaacgugagcuacagcggcaccagcaaggccugcagcgacagcuucuacagaaacaugagauggcugacccagaaggacaacaacuaccccgugcaggacgcccaguacaccaacaacagaggcaagaacauccuguucauguggggcaucaaccacccccccaccgacaccgcccagaccaaccuguacaccagaaccgacaccaccaccagcguggccaccgaggacaucaacagaaccuucaagccccugaucggccccagaccccuggugaacggccugcagggcagaaucgacuacuacugggccgugcugaagcccggccagacccugagagugagaagcaacggcaaccugaucgcccccugguacggccacauccugcugggcgagagccacggcagaauccugaagaccgaccugaagagcggcaacugcguggugcagugccagaccgagagaggcggccugaacaccacccugcccuuccacaacgugagcaaguacgccuucggcaacugccccaaguacaucggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgagaucaucgaccacgaguucagcgagaucgagaccagacugaacaugaucaacgacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgaccuguaccacaagugcgacaaccagugcauggagaccaucagaaacggcaccuacaacagaagaaaguaccagaaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162798 - RNA, 1683 nt, Artificial Sequence
  derived and/or modified sequence opt4 from hemagglutinin__InfluenzaA__AGQ81125
auggagguggccacccugaucaccauccugcuggugaucaccggcagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggcagaccccugauccuggacaccugcaccaucgagggccugaucuacggcaaccccagcugcgaccugccccuggagggcagagaguggagcuacaucguggagagacccagcgccgugaacggcgugugcuaccccggcaacguggagaaccuggaggagcugagaagccuguucagcagcgccagcagcuaccagagaauccagaucuuccccgacagcaucuggaacgugagcuacagcggcaccagcaaggccugcagcgacagcuucuacagaagcaugagauggcugacccagaaggacaacaacuaccccgugcaggacgcccaguacaccaacaacagaggcaagaacauccuguucauguggggcaucaaccacccccccaccgacaccgcccagaccaaccuguacaccagaaccgacaccaccaccagcguggccaccgaggacaucaacagaaccuucaagccccugaucggccccagaccccuggugaacggccugcagggcagaaucgacuacuacugggccgugcugaagcccggccagacccugagagugagaagcaacggcaaccugaucgcccccugguacggccacauccugcugggcgugagccacggcagaauccugaagaccgaccugaagagcggcaacugcguggugcagugccagaccgagagaggcggccugaacaccacccugcccuuccacaacgugagcaaguacgccuucggcaacugccccaaguacaucggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgagaucaucgaccacgaguucagcgagaucgagaccagacugaacaugaucaacgacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgaccuguaccacaagugcgacaaccagugcauggagaccaucagaaacggcaccuacaacagaagaaaguaccaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162799 - RNA, 1683 nt, Artificial Sequence
  derived and/or modified sequence opt4 from hemagglutinin__InfluenzaA__AGQ81126
auggagaccaucagccugaugaccauccugcugaucaccaccgccagcaacgccgacaagaucugcaucggccaccagagcaccaacagcaccgagaccguggacacccugaccgagaccaacgugcccgugacccacgccaaggagcugcugcagaccgagcacaacggcaugcugugcgccaccaaccugggccacccccugauccuggacaccugcaccaucgagggccugaucuacggcaaccccagcugcgaccugcugcuggagggcagagaguggagcuacaucguggagagacccagcgccgugaacggcaccugcuaccccggcaacguggagaaccuggaggagcugagaacccuguucagcagcgccagcagcuaccagagaauccagaucuuccccgacaccaucuggaacgugaccuacaccggcaccagcagaagcugcagcggcagcuucuacagaagcaugagauggcugacccagaagagcggcuucuaccccgugcaggacgccaaguacaccaacaacagaggcaagaacauccuguucguguggggcauccaccacccccacaccuacaccgaccagaccacccuguacaucagaaacgacaccaccaccagcgugaccaccgaggagcugaacagaaucuucaagcccgugaucgugcccagacugcuggugaacggccagcagggcagaaucgacuacuacuggagcgugcugaagcccggccagacccugagagugagaagcaacggcaaccugaucgcccccugguacggccacgugcugagcggcggcagccacggcagaauccugaagaccgaccugaagggcggcaacugcguggugcagugccagaccgagaagggcggcuucaacagcacccugcccuuccacaacaucagcaaguacgccuucggcaccugccccaaguacgugaaggugaacagccugaagcuggccaucggccugagaaacgugcccgccagaagcaacagaggccuguucggcgccaucgccggcuucaucgagggcggcuggcccggccugguggccggcugguacggcuuccagcacagcaacgaccagggcgugggcauggccgccgacagagacagcacccagaaggccguggacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccauggaggacggcaagggcugcuucgagcuguaccacaagugcgacgaccagugcauggagaccaucagaaacggcaccuacaacagaagaaaguacagagaggagagcagacuggagcagcagagaaucgagggcgugaagcuggagagcgagggcaccuacaagauccugaccaucuacagcaccguggccagcagccuggugcuggccaugggcuucgccgccuuccuguucugggccaugagcaacggcagcugcagaugcaacaucugcaucuga

SEQ ID NO: 162800 - RNA, 1683 nt, Artificial Sequence
  derived and/or modified sequence opt4 from hemagglutinin__InfluenzaA__AGQ81127
auggagguggccacccugaucaccauccugcugcugaucaccggcagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggcagaccccugauccuggacaccugcaccaucgagggccugaucuacggcaaccccagcugcgaccugccccuggagggcagagaguggagcuacaucguggagagacccagcgccgugaacggcgugugcuaccccggcaacguggagaaccuggaggagcugagaagccuguucagcagcgccagcagcuaccagagaauccagaucuuccccgacagcaucuggaacgugagcuacagcggcaccagcaaggccugcagcgacagcuucuacagaagcaugagauggcugacccagaagaacaacaacuaccccgugcaggacgcccaguacaccaacaacagaggcaagaacauccuguucauguggggcaucaaccacccccccaccgacaccgcccagaccaaccuguacaccagaaccgacaccaccaccagcguggccaccgaggacaucaacagaaccuucaagccccugaucggccccagaccccuggugaacggccugcagggcagaaucgacuacuacugggccgugcugaagcccggccagacccugagagugagaagcaacggcaaccugaucgcccccugguacggccacauccugcugggcgagagccacggcagaauccugaagaccgaccugaagagcggcaacugcguggugcagugccagaccgagagaggcggccugaacaccacccugcccuuccacaacgugagcaaguacgccuucggcaacugccccaaguacaucggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgagaucaucgaccacgaguucagcgagaucgagaccagacugaacaugaucaacgacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgaccuguaccacaagugcgacaaccagugcauggagaccaucagaaacggcaccuacaacagaagaaaguaccaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162801 - RNA, 1683 nt, Artificial Sequence
  derived and/or modified sequence opt4 from hemagglutinin__InfluenzaA__AGQ81128
auggaggccgccaccaucaucaccauccugcuggugaucaccggcagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggcagaccccugauccuggacaccugcaccaucgagggccugaucuacggcaaccccagcugcgaccugccccuggagggcagagaguggagcuacaucguggagagacccagcgccgugaacggcgugugcuaccccggcaacguggagaaccuggaggagcugagaagccuguucagcagcgccagcagcuaccagagaauccagaucuuccccgacagcaucuggaacgugagcuacagcggcaccagcaaggccugcagcgacagcuucuacagaagcaugagauggcugacccagaagaacaacaacuaccccgugcaggacgcccaguacaccaacaacagaggcaagaacauccuguucauguggggcaucaaccacccccccaccgacaccgcccagaccaaccuguacaccagaaccgacaccaccaccagcguggccaccgaggacaucaacagaaccuucaagccccugaucggccccagaccccuggugaacggccugcagggcagaaucgacuacuacugggccgugcugaagcccggccagacccugagagugagaagcaacggcaaccugaucgcccccugguacggccacauccugcugggcgagagccacggcagaauccugaagaccgaccugaagagcggcaacugcguggugcagugccagaccgagagaggcggccugaacaccacccugcccuuccacaacgugagcaaguacgccuucggcaacugccccaaguacaucggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgacaucaucgaccacgaguucagcgagaucgagaccagacugaacaugaucaacgacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgaccuguaccacaagugcgacaaccagugcauggagaccaucagaaacggcaccuacaacagaagaaaguaccaggaggagagcagacuggagagacagaagaucgagggcgugaagcuggagagcgagggcaccuacaagauccugaccaucuacagcaccguggccagcagccuggugguggccaugggcuucgccgccuuccuguucugggccaugagcaacggcagcugcagaugcaacaucugcaucuga

SEQ ID NO: 162802 - RNA, 1683 nt, Artificial Sequence
  derived and/or modified sequence opt4 from hemagglutinin__InfluenzaA__AGQ81130
auggagaccgugagccugaucaccauccugcugguggugaccaucggcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccagccugggccacccccugauccuggacaccugcaccaucgagggccugaucuacggcaaccccagcugcgaccugcugcugggcggcagagaguggagcuacaucguggagagacccagcgccgugaacggccugugcuaccccggcaacguggagaaccuggaggagcugagaagccuguucagcagcgccagaagcuaccagagaauccagaucuuccccgacaccaucuggaacgugagcuacagcggcaccagcaaggccugcagcgacagcuucuacagaagcaugagauggcugacccagaagaacaacgccuaccccauccaggacgcccaguacaccaacaaccaggagaagaacauccuguucauguggggcaucaaccacccccccaccgacaccgugcagaccaaccuguacaccagaaccgacaccaccaccagcguggccaccgaggagaucaacagaaccuucaagccccugaucggccccagaccccuggugaacggccugcagggcagaaucgacuacuacuggagcgugcugaagcccggccagacccugagaaucagaagcaacggcaaccugaucgcccccugguacggccacauccugagcggcgagagccacggcagaauccugaagaccgaccugaagagaggcagcugcaccgugcagugccagaccgagaagggcggccugaacaccacccugcccuuccagaacgugagcaaguacgccuucggcaacugcagcaaguacaucggcaugaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcuucaacgccguggaggacggcaagggcugcuucgagcuguaccacaagugcgacgaccagugcauggagaccaucagaaacggcaccuacaacagaagaaaguaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162803 - RNA, 1683 nt, Artificial Sequence
  derived and/or modified sequence opt4 from hemagglutinin__InfluenzaA__AGQ81132
auggagaccaucagccugaugaccauccugcugaucaccaccgccagcaacgccgacaagaucugcaucggccaccagagcaccaacagcaccgagaccguggacacccugaccgagaccaacgugcccgugacccacgccaaggagcugcugcagaccgagcacaacggcaugcugugcgccaccaaccugggccacccccugauccuggacaccugcaccaucgagggccugaucuacggcaaccccagcugcgaccugcugcuggagggcagagaguggagcuacaucguggagagacccagcgccgugaacggcaccugcuaccccggcaacguggagaaccuggaggagcugagaacccuguucagcagcgccagcagcuaccagagaauccagaucuuccccgacaccaucuggaacgugaccuacaccggcaccagcagaagcugcagcggcagcuucuacagaagcaugagauggcugacccagaagagcggcuucuaccccgugcaggacgccaaguacaccaacaacagaggcaagaacauccuguucguguggggcauccaccacccccacaccuacaccgaccagaccacccuguacaucagaaacgacaccaccaccagcgugaccaccgaggagcugaacagaaucuucaagcccgugaucgugcccagacugcuggugaacggccagcagggcagaaucgacuacuacuggagcgugcugaagcccggccagacccugagagugagaagcaacggcaaccugaucgcccccugguacggccacgugcugagcggcggcagccacggcagaauccugaagaccgaccugaagggcggcaacugcguggugcagugccagaccgagaagggcggcuucaacagcacccugcccuuccacaacaucagcaaguacgccuucggcaccugccccaaguacgugaaggugaacagccugaagcuggccaucggccugagaaacgugcccgccagaagcaacagaggccuguucggcgccaucgccggcuucaucgagggcggcuggcccggccugguggccggcugguacggcuuccagcacagcaacgaccagggcgugggcauggccgccgacagagacagcacccagaaggccguggacaagaucaccagcaaggugaacaacaucguggacaagaugaacagacaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccauggaggacggcaagggcugcuucgagcuguaccacaagugcgacgaccagugcauggagaccaucagaaacggcaccuacaacagaagaaaguacagagaggagagcagacuggagcagcagagaaucgagggcgugaagcuggagagcgagggcaccuacaagauccugaccaucuacagcaccguggccagcagccuggugcuggccaugggcuucgccgccuuccuguucugggccaugagcaacggcagcugcagaugcaacaucugcaucuga

SEQ ID NO: 162804 - RNA, 1683 nt, Artificial Sequence
  derived and/or modified sequence opt4 from hemagglutinin__InfluenzaA__AGQ81133
auggagaccaucagccugaugaccauccugcugaucaccaccgccagcaacgccgacaagaucugcaucggccaccagagcaccaacagcaccgagaccguggacacccugaccgagaccaacgugcccgugacccacgccaaggagcugcugcagaccgagcacaacggcaugcugugcgccaccaaccugggccacccccugauccuggacaccugcaccaucgagggccugaucuacggcaaccccagcugcgaccugcugcuggagggcagagaguggagcuacaucguggagagacccagcgccgugaacggcaccugcuaccccggcaacguggagaaccuggaggagcugagaacccuguucagcagcgccagcagcuaccagagaauccagaucuuccccgacaccaucuggaacgugaccuacaccggcaccagcagaagcugcagcggcagcuucuacagaagcaugagauggcugacccagaagagcggcuucuaccccgugcaggacgccaaguacaccaacaacagaggcaagaacauccuguucguguggggcauccaccacccccacaccuacaccgaccagaccacccuguacaucagaaacgacaccaccaccagcgugaccaccgaggagcugaacagaaucuucaagcccgugaucgugcccagacugcuggugaacggccagcagggcagaaucgacuacuacuggagcgugcugaagcccggccagacccugagagugagaagcaacggcaaccugaucgcccccugguacggccacauccugagcggcggcagccacggcagaauccugaagaccgaccugaagagcggcaacugcguggugcagugccagaccgagaagggcggcuucaacagcacccugcccuuccacaacaucagcaaguacgccuucggcaccugccccaaguacgugaaggugaacagccugaagcuggccaucggccugagaaacgugcccgccagaagcaacagaggccuguucggcgccaucgccggcuucaucgagggcggcuggcccggccugguggccggcugguacggcuuccagcacagcaacgaccagggcgugggcauggccgccgacagagacagcacccagaaggccguggacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccauggaggacggcaagggcugcuucgagcuguaccacaagugcgacgaccagugcauggagaccaucagaaacggcaccuacaacagaagaaaguacagagaggagagcagacuggagcagcagagaaucgagggcgugaagcuggagagcgagggcaccuacaagauccugaccaucuacagcaccguggccagcagccuggugcuggccaugggcuucgccgccuuccuguucugggccaugagcaacggcagcugcagaugcaacaucugcaucuga

SEQ ID NO: 162805 - RNA, 1683 nt, Artificial Sequence
  derived and/or modified sequence opt4 from hemagglutinin__InfluenzaA__AGQ81134
auggagaccaucagccugaugaccauccugcugaucaccaccgccagcaacgccgacaagaucugcaucggccaccagagcaccaacagcaccgagaccguggacacccugaccgagaccaacgugcccgugacccacgccaaggagcugcugcagaccgagcacaacggcaugcugugcgccaccaaccugggccacccccugauccuggacaccugcaccaucgagggccugaucuacggcaaccccagcugcgaccugcugcuggagggcagagaguggagcuacaucguggagagacccagcgccgccaacggcaccugcuaccccggcaacguggagaaccccgaggagcugagaacccuguucagcagcgccagcagcuaccagagaauccagaucuuccccgacaccaucuggaacgugaccuacaccggcaccagcagaagcugcagcggcagcuucuacagaagcaugagauggcugacccagaagagcggcuucuaccccgugcaggacgccaaguacaccaacaacagaggcaagaacauccuguucguguggggcauccaccacccccacaccuacaccgaccagaccacccuguacaucagaaacgacaccaccaccagcgugaccaccgaggagcugaacagaaucuucaagcccgugaucgugcccagacugcuggugaacggccagcagggcagaaucgacuacuacuggagcgugcugaagcccggccagacccugagagugagaagcaacggcaaccugaucgcccccugguacggccacgugcugagcggcggcagccacggcagaauccugaagaccgaccugaagagcggcaacugcguggugcagugccagaccgagaagggcggcuucaacagcacccugcccuuccacaacaucagcaaguacgccuucggcaccugccccaaguacgugaaggugaacagccugaagcuggccaucggccugagaaacgugcccgccagaagcaacagaggccuguucggcgccaucgccggcuucaucgagggcggcuggcccggccugguggccggcugguacggcuuccagcacagcaacgaccagggcgugggcauggccgccgacagagacagcacccagaaggccguggacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccauggaggacggcaagggcugcuucgagcuguaccacaagugcgacgaccagugcauggagaccaucagaaacggcaccuacaacagaagaaaguacagagaggagagcagacuggagcagcagagaaucgagggcgugaagcuggagagcgagggcaccuacaagauccugaccaucuacagcaccguggccagcagccuggugcuggccaugggcuucgccgccuuccuguucugggccaugagcaacggcagcugcagaugcaacaucugcaucuga

SEQ ID NO: 162806 - RNA, 1683 nt, Artificial Sequence
  derived and/or modified sequence opt4 from hemagglutinin__InfluenzaA__AGQ81135
auggagguggccaccaucaucaccauccugcuggugaucaccggcagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggcagaccccugauccuggacaccugcaccaucgagggccugaucuacggcaaccccagcugcgaccugccccuggagggcagagaguggagcuacaucguggagagacccagcgccgugaacggcgugugcuaccccggcaacguggagaaccuggaggagcugagaagccuguucagcagcgccagcagcuaccagagaauccagaucuuccccgacagcaucuggaacgugagcuacagcggcaccagcaaggccugcagcgacagcuucuacagaagcaugagauggcugacccagaagaacaacaacuaccccgugcaggacgcccaguacaccaacaacagaggcaagaacauccuguucauguggggcaucaaccacccccccaccgacaacgcccagaccaaccuguacaccagaaccgacaccaccaccagcguggccaccgaggacaucaacagaaccuucaagccccugaucggccccagaccccuggugaacggccugcagggcagaaucgacuacuacugggccgugcugaagcccggccagacccugagagugagaagcaacggcaaccugaucgcccccugguacggccacauccugcugggcgagagccacggcagaauccugaagaccgaccugaagagcggcaacugcguggugcagugccagaccgagagaggcggccugaacaccacccugcccuuccacaacgugagcaaguacagcuucggcaacugccccaaguacaucggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgagaucaucgaccacgaguucaacgagaucgagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgaccuguaccacaagugcgacaaccagugcauggagaccaucagaaacggcaccuacaacagaagaaaguaccaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162807 - RNA, 1683 nt, Artificial Sequence
  derived and/or modified sequence opt4 from hemagglutinin__InfluenzaA__AGQ81136
auggagaccaucagccugaugaccauccugcugaucaccaccgccagcaacgccgacaagaucugcaucggccaccagagcaccaacagcaccgagaccguggacacccugaccgagaccaacgugcccgugacccacgccaaggagcugcugcagaccgagcacaacggcaugcugugcgccaccaaccugggccacccccugauccuggacaccugcaccaucgagggccugaucuacggcaaccccagcugcgaccugcugcuggagggcagagaguggagcuacaucguggagagacccagcgccgugaacggcaccugcuaccccggcaacguggagaaccuggaggagcugagaacccuguucagcagcgccagcagcuaccagagaauccagaucuuccccgacaccaucuggaacgugaccuacaccggcaccagcagaagcugcagcggcagcuucuacagaagcaugagauggcugacccagaagagcggcuucuaccccgugcaggacgccaaguacaccaacaacagaggcaagaacauccuguucguguggggcauccaccacccccacaccuacaccgaccagaccacccuguacaucagaaacgacaccaccaccagcgugaccaccgaggagcugaacagaaucuucaagcccgugaucgugcccagacugcuggugaacggccagcagggcagaaucgacuacuacuggagcgugcugaagcccggccagacccugagagugagaagcaacggcaaccugaucgcccccugguacggccacgugcugagcggcggcagccacggcagaauccugaagaccgaccugaagggcggcaacugcguggugcagugccagaccgagaagggcggcuucaacagcacccugcccuuccacaacaucagcaaguacgccuucggcaccugccccaaguacgugaaggugaacagccugaagcuggccaucggccugagaaacgugcccgccagaagcaacagaggccuguucggcgccaucgccggcuucaucgagggcggcuggcccggccugguggccggcugguacggcuuccagcacagcaacgaccagggcgugggcauggccgccgacagagacagcacccagaaggccguggacaagaucaccagcaaggugaacaacaucguggacaagaugaacagacaguacgagaucaucgaccacgaguucagcgagguggagaccagacugaacaugaucaacaacaagaucgacgaccagauccaggacaucuggaccuacaacgccgagcugcuggugcugcuggagaaccagaagacccuggacgagcacgacgccaacgugaacaaccuguacaacaaggugaagagagcccugggcagcaacgccauggaggacggcaagggcugcuucgagcuguaccacaagugcgacgaccagugcauggagaccaucagaaacggcaccuacaacagaagaaaguacagagaggagagcagacuggagcagcagagaaucgagggcgugaagcuggagagcgagggcaccuacaagauccugaccaucuacagcaccguggccagcagccuggugcuggccaugggcuucgccgccuuccuguucugggccaugagcaacggcagcugcagaugcaacaucugcaucuga

SEQ ID NO: 162808 - RNA, 1683 nt, Artificial Sequence; identical to SEQ ID NO: 162803
  derived and/or modified sequence opt4 from hemagglutinin__InfluenzaA__AGQ81137

SEQ ID NO: 162809 - RNA, 1683 nt, Artificial Sequence
  derived and/or modified sequence opt4 from hemagglutinin__InfluenzaA__AGQ81138
auggaggccgccaccaucaucaccauccugcuggccaucaccggcagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggcagaccccugauccuggacaccugcaccaucgagggccugaucuacggcaaccccagcugcgaccugccccuggagggcagagaguggagcuacaucguggagagacccagcgccgugaacggcgugugcuaccccggccacguggagaaccuggaggagcugagaagccuguucagcagcgccagcagcuaccagagagugcagaucuuccccgacagcaucuggaacgugagcuacagcggcaccagcaaggccugcagcgacagcuucuacagaagcaugagauggcugacccagaagaacaacaacuaccccgugcaggacgcccaguacaccaacaacaagggcaagaacauccuguucauguggggcaucaaccacccccccaccgacaccgcccagaccaaccuguacaccagaaccgacaccaccaccagcguggccaccgaggacaucaacagaaccuucaagccccugaucggccccagaccccuggugaacggccugcagggcagaaucgacuacuacugggccgugcugaagcccggccagacccugagagugagaagcaacggcaaccugaucgcccccugguacggccacauccugcugggcgagagccacggcagaauccugaagaccgaccugaagagcggcaacugcguggugcagugccagaccgagagaggcggccugaacaccacccugcccuuccacaacgugagcaaguacgccuucggcaacugccccaaguacaucggcgugaagagccugaagcuggccgugggccugagaaacgugcacgccagaagcagcagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgagaucaucgaccacgaguucagcgagaucgagaccagacugaacaugaucaacgacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgaccuguaccacaagugcgacaaccagugcauggagaccaucagaaacggcaccuacaacagaagaaaguaccaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162810 - RNA, 1683 nt, Artificial Sequence
  derived and/or modified sequence opt4 from hemagglutinin__InfluenzaA__AGQ81139
auggagguggccaccaucaucaccauccugcuggugaucaccggcggcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggcagaccccugauccuggacaccugcaccaucgagggccugaucuacggcaaccccagcugcgaccugccccuggagggcagagaguggagcuacaucguggagagaagcagcgccgugaacggcgugugcuaccccggcaacguggagaaccuggaggagcugagaagccuguucagcagcgccagcagcuaccagagaauccagaucuuccccgacagcaucuggaacgugagcuacagcggcaccagcaaggccugcagcgacagcuucuacagaagcaugagauggcugacccagaagaacaacaacuaccccgugcaggacgcccaguacaccaacaacagaggcaagaacauccuguucauguggggcaucaaccacccccccaccgacaacgcccagaccaaccuguacaccagaaccgacaccaccaccagcguggccaccgaggacaucaacagaaccuucaagccccugaucggccccagaccccuggugaacggccugcagggcagaaucgacuacuacugggccgugcugaagcccggccagacccugagagugagaagcaacggcaaccugaucgcccccugguacggccacauccugcugggcgagagccacggcagaauccugaagaccgaccugaagagcggcaacugcguggugcagugccagaccgagagaggcggccugaacaccacccugcccuuccacaacgugagcaaguacagcuucggcaacugccccaaguacaucggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgagaucaucgaccacgaguucagcgagaucgagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgaccuguaccacaagugcgacaaccagugcauggagaccaucagaaacggcaccuacaacagaagaaaguaccaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162811 - RNA, 1683 nt, Artificial Sequence
  derived and/or modified sequence opt4 from hemagglutinin__InfluenzaA__AGQ81141
auggaggccgccaccaucaucaccauccugcuggugaucaccggcagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccgaccugggcagaccccugauccuggacaccugcaccaucgagggccugaucuacggcaaccccagcugcgaccugccccuggagggcagagaguggagcuacaucguggagagacccagcgccgugaacggcgugugcuaccccggcaacguggagaaccuggaggagcugagaagccuguucagcagcgccagcagcuaccagagaauccagaucuuccccgacagcaucuggaacgugagcuacagcggcaccagcaaggccugcagcgacagcuucuacagaagcaugagauggcugacccagaagaacaacaacuaccccgugcaggacgcccaguacaccaacaacagaggcaagaacauccuguucauguggggcaucaaccacccccccaccgacaccgcccagaccaaccuguacaccagaaccgacaccaccaccagcguggccaccgaggacaucaacagaaccuucaagccccugaucggccccagaccccuggugaacggccugcagggcagaaucgacuacuacugggccgugcugaagcccggccagacccugagagugagaagcaacggcaaccugaucgcccccugguacggccacauccugcugggcgagagccacggcagaauccugaagaccgaccugaagagcggcaacugcguggugcagugccagaccgagagaggcggccugaacaccacccugcccuuccacaacgugagcaaguacgccuucggcaacugccccaaguacaucggcgugaagagccugaagcuggccgugggccugagaaacgugcccgccagaagcagaagaggccuguucggcgccaucgccggcuucaucgagggcggcuggaccggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgacaucaucgaccacgaguucagcgagaucgagaccagacugaacaugaucaacgacaagaucgacgaccagauccaggacaucugggccuacaacgccgagcugcuggugcugcuggagaaccagaagacccuggacgagcacgacgccaacgugaacaaccuguacaacaaggugaagggcgcccugggcagcaacgccguggaggacggcaagggcugcuucgaccuguaccacaagugcgacaaccagugcauggagaccaucagaaacggcaccuacaacagaagaaaguaccaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162812 - RNA, 1683 nt, Artificial Sequence
  derived and/or modified sequence opt4 from hemagglutinin__InfluenzaA__AGQ81143
auggagguggccaccaucaucaccauccugcuggugaucaccggcagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggcagaccccugauccuggacaccugcaccaucgagggccugaucuacggcaaccccagcugcgaccugccccuggagggcagagaguggagcuacaucguggagagacccagcgccgugaacggcgugugcuaccccggcaacguggagaaccuggaggagcugagaagccuguucagcagcgccagcagcuaccagagaauccagaucuuccccgacagcaucuggaacgugagcuacagcggcaccagcaaggccugcagcgacagcuucuacagaagcaugagauggcugacccagaagaacaacaacuaccccgugcaggacgcccaguacaccaacaacagaggcaagaacauccuguucauguggggcaucaaccacccccccaccgacaacgcccagaccaaccuguacaccagaaccgacaccaccaccagcguggccaccgaggacaucaacagaaccuucaagccccugaucggccccagaccccuggugaacggccugcagggcagaaucgacuacuacugggccgugcugaagcccggccagacccugagagugagaagcaacggcaaccugaucgcccccugguacggccacauccugcugggcgagagccacggcagaauccugaagaccgaccugaagagcggcaacugcguggugcagugccagaccgagagaggcggccugaacaccacccugcccuuccacaacgugagcaaguacagcuucggcaacugccccaaguacaucggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgagaucaucgaccacgaguucagcgagaucgagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgaccuguaccacaagugcgacaaccagugcauggagaccaucagaaacggcaccuacaacagaagaaaguaccaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162813 - RNA, 1683 nt, Artificial Sequence
  derived and/or modified sequence opt4 from hemagglutinin__InfluenzaA__AGQ81144
auggaggccgccaccaucaucaccauccugcugguggugaccggcagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggcagaccccugauccuggacaccugcaccaucgagggccugaucuacggcaaccccagcugcgaccugccccuggagggcagagaguggagcuacaucguggagagacccagcgccgugaacggcgugugcuaccccggcaacguggagaaccuggaggagcugagaagccuguucagcagcgccagcagcuaccagagaauccagaucuuccccgacagcaucuggaacgugagcuacggcggcaccagcaaggccugcagcgacagcuucuacagaagcaugagauggcugacccagaagaacaacaacuaccccgugcaggacgcccaguacaccaacaacagaggcaagaacauccuguucauguggggcaucaaccacccccccaccgacaccgcccagaccaaccuguacaccagaaccgacaccaccaccagcguggccaccgaggacaucaacagaaccuucaagccccugaucggccccagaccccuggugaacggccugcagggcagaaucgacuacuacugggccgugcugaagcccggccagacccugagagugagaagcaacggcaaccugaucgcccccugguacggccacauccugcugggcgagagccacggcagaauccugaagaccgaccugaagagcggcaacugcguggugcagugccagaccgagagaggcggccugaacaccacccugcccuuccacaacgugagcaaguacgccuucggcaacugccccaaguacaucggcgugaagagccugaagcuggccgugggccugagaaacaugcccgccagaagcagcagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgagaucaucgaccacgaguucagcgagaucgagaccagacugaacaugaucaacgacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgaccuguaccacaagugcgacaaccagugcauggagaccaucagaaacggcaccuacaacagaagaaaguaccaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162814 - RNA, 1683 nt, Artificial Sequence
  derived and/or modified sequence opt4 from hemagglutinin__InfluenzaA__AGQ81146
auggaggccgccaccaucaucaccauccugcuggugaucaccggcagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggcagaccccugauccuggacaccugcaccaucgagggccugaucuacggcaaccccagcugcgaccugccccuggagggcaaggaguggagcuacaucguggagagacccagcgccgugaacggcaugugcuaccccggcaacguggagaaccuggaggagcugagaagccuguucagcagcgccagcagcuaccagagaauccagaucuuccccgacagcaucuggaacgugagcuacagcggcaccagcaaggccugcagcgacagcuucuacagaagcaugagauggcugacccagaagaacaacaacuaccccgugcaggacgcccaguacaccaacaacagaggcaagaacauccuguucauguggggcaucaaccacccccccaccgacaccgcccagaccaaccuguacaccagaaccgacaccaagaccagcguggccaccgaggagaucaacagaaccuucaagccccugaucggccccagaccccuggugaacggccugcagggcagaaucgacuacuacugggccgugcugaagcccggccagacccugagagugagaagcaacggcaaccugaucgcccccugguacggccacauccugcugggcgagagccacggcagaauccugaagaccgaccugaagagcggcaacugcguggugcagugccagaccgagagaggcggccugaacaccacccugcccuuccacaacgugagcaaguacgccuucggcaacugccccaaguacaucggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgagaucaucgaccacgaguucagcgagaucgagaccagacugaacaugaucaacgacaagaucgacgaccagauccaggacaucugggccuacaacgccgagcugcuggugcugcuggagaaccagaagacccuggacgagcacgacagcaacgugaacaaccuguacaacaaggugaagagagcccugggcagcaacgccguggaggacggcaagggcugcuucgaccuguaccacaagugcgacaaccagugcauggagaccaucagaaacggcaccuacaacagaagaaaguaccaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162815 - RNA, 1683 nt, Artificial Sequence
  derived and/or modified sequence opt4 from hemagglutinin__InfluenzaA__AGQ81147
auggaggccgccaccaucaucaccauccugcuggugaucaccggcagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggcagaccccugauccuggacaccugcaccaucgagggccugaucuacggcaaccccagcugcgaccugccccuggagggcaaggaguggagcuacaucguggagagacccagcgccgugaacggcaugugcuaccccggcaacguggagaaccuggaggagcugagaagccuguucagcagcgccagcagcuaccagagaauccagaucuuccccgacagcaucuggaacgugagcuacagcggcaccagcaaggccugcagcgacagcuucuacagaagcaugagauggcugacccagaagaacaacaacuaccccgugcaggacgcccaguacaccaacaacagaggcaagaacauccuguucauguggggcaucaaccacccccccaccgacaccgugcagaccaaccuguacaccagaaccgacaccaagaccagcguggccaccgaggagaucaacagaaccuucaagccccugaucggccccagaccccuggugaacggccugcagggcagaaucgacuacuacugggccgugcugaagcccggccagacccugagagugagaagcaacggcaaccugaucgcccccugguacggccacauccugcugggcgagagccacggcagaauccugaagaccgaccugaagagcggcaacugcguggugcagugccagaccgagagaggcggccugaacaccacccugcccuuccacaacgugagcaaguacgccuucggcaacugccccaaguacaucggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgagaucaucgaccacgaguucagcgagaucgagaccagacugaacaugaucaacgacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgaccuguaccacaagugcgacaaccagugcauggagaccaucagaaacggcaccuacaacagaagaaaguaccaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162816 - RNA, 1683 nt, Artificial Sequence
  derived and/or modified sequence opt4 from hemagglutinin__InfluenzaA__AGQ81148
auggaggccgccaccaucaucaccauccugcuggugaucaccggcagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggcagaccccugauccuggacaccugcaccaucgagggccugaucuacggcaaccccagcugcgaccugccccuggagggcaaggaguggagcuacaucguggagagacccagcgccgugaacggcaugugcuaccccggcaacguggagaaccuggaggagcugagaagccuguucagcagcgccagcagcuaccagagaauccagaucuuccccgacagcaucuggaacgugagcuacagcggcaccagcaaggccugcagcgacagcuucuacagaagcaugagauggcugacccagaagaacaacaacuaccccgugcaggacgcccaguacaccaacaacagaggcaagaacauccuguucauguggggcaucaaccacccccccaccgacaccgcccagaccaaccuguacaccagaaccgacaccaagaccagcguggccaccgaggagaucaacagaaccuucaagccccugaucggccccagaccccuggugaacggccugcagggcagaaucgacuacuacugggccgugcugaagcccggccagacccugagagugagaagcaacggcaaccugaucgcccccugguacggccacauccugcugggcgagagccacggcagaauccugaagaccgaccugaagagcggcaacugcguggugcagugccagaccgagagaggcggccugaacaccacccugcccuuccacaacgugagcaaguacgccuucggcaacugccccaaguacaucggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgagaucaucgaccacgaguucagcgagaucgagaccagacugaacaugaucaacgacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgaccuguaccacaagugcgacaaccagugcauggagaccaucagaaacggcaccuacaacagaagaaaguaccaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162817 - RNA, 1683 nt, Artificial Sequence
  derived and/or modified sequence opt4 from hemagglutinin__InfluenzaA__AGQ81149
auggaggccgccaccaucaucaccauccugcuggugaucaccggcagcaacgccgacaagaucugcaucggcuaccagagcaccaacagcaccgagaccguggacacccugaccgagaacaacgugcccgugacccacgccaaggagcugcugcacaccggccacaacggcaugcugugcgccaccaaccugggcagaccccugauccuggacaccugcaccaucgagggccugaucuacggcaaccccagcugcgaccugccccuggagggcagagaguggagcuacaucguggagagacccagcgccaucaacggcgugugcuaccccggcaacguggagaaccuggaggagcugagaagccuguucagcagcgccagcagcuaccagagaauccagaucuuccccgacagcaucuggaacgugagcuacagcggcaccagcaaggccugcagcgacagcuucuacagaagcaugagauggcugacccagaagaacaacaacuaccccgugcaggacgcccaguacaccaacaacagaggcaagaacauccuguucauguggggcaucaaccacccccccaccgacaccgcccagaccaaccuguacaccagaaccgacaccaccaccagcguggccaccgaggacaucaacagaaccuucaagccccugaucggccccagaccccuggugaacggccugcagggcagaaucgacuacuacugggccgugcugaagcccggccagacccugagagugagaagcaacggcaaccugaucgcccccugguacggccacauccugcugggcgagagccacggcagaauccugaagaccgaccugaagagcggcaacugcguggugcagugccagaccgagagaggcggccugaacaccacccugcccuuccacaacgugagcaaguacgccuucggcaacugccccaaguacaucggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgagaucaucgaccacgaguucagcgagaucgagaccagacugaacaugaucaacgacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgaccuguaccacaagugcgacaaccagugcauggagaccaucagaaacggcaccuacaacagaagaaaguaccaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162818 - RNA, 1683 nt, Artificial Sequence
  derived and/or modified sequence opt4 from hemagglutinin__InfluenzaA__AGQ81150
auggaggccgccaccaucaucaccauccugcuggugaucaccggcagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccgaccugggcagaccccugauccuggacaccugcaccaucgagggccugaucuacggcaaccccagcugcgaccugccccuggagggcagagaguggagcuacaucguggagagacccagcgccgugaacggcgugugcuaccccggcaacguggagaaccuggaggagcugagaagccuguucagcagcgccagcagcuaccagagaauccagaucuuccccgacagcaucuggaacgugagcuacagcggcaccagcaaggccugcagcgacagcuucuacagaagcaugagauggcugacccagaagaacaacaacuaccccgugcaggacgcccaguacaccaacgacagaggcaacaacauccuguucauguggggcaucaaccacccccccaccgacaccgugcagaccaaccuguacaccagaaccgacaccaccaccagcguggccaccgaggacaucaacagaaccuucaagccccugaucggccccagaccccuggugaacggccugcagggcagaaucgacuacuacugggccgugcugaagcccggccagacccugagagugagaagcaacggcaaccugaucgcccccugguacggccacauccugcugggcgagagccacggcagaauccugaagaccgaccugaagagcggcaacugcguggugcagugccagaccgagagaggcggccugaacaccacccugcccuuccacaacgugagcaaguacgccuucggcaacugccccaaguacaucggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgacaucaucgaccacgaguucagcgagaucgagaccagacugaacaugaucaacgacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgaccuguaccacaagugcgacaaccagugcauggagaccaucagaaacggcaccuacaacagaagaaaguaccaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162819 - RNA, 1683 nt, Artificial Sequence
  derived and/or modified sequence opt4 from hemagglutinin__InfluenzaA__AGQ81152
auggaggccgccaccaucaucaccauccugcuggugaucaccggcagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggcagaccccugauccuggacaccugcaccaucgagggccugaucuacggcaaccccagcugcgaccugccccuggagggcagagacuggagcuacaucguggagagacccagcgccgugaacggcgugugcuaccccggcaacguggagaaccuggaggagcugagaagccuguucagcagcgccagcagcuaccagaagauccagaucuuccccgacagcaucuggaacgugagcuacagcggcaccagcaaggccugcagcgacagcuucuacagaagcaugagauggcugacccagaagaacaacaacuaccccgugcaggacgcccaguacaccaacaacagaggcaagaacauccuguucauguggggcaucaaccacccccccaccgacaccgugcagaccaaccuguacaccagaaccgacaccaccaccagcguggccaccgaggacaucaacagaaccuucaagccccugaucggccccagaccccuggugaacggccugcagggcagaaucgacuacuacugggccgugcugaagcccggccagacccugagagugagaagcaacggcaaccugaucgcccccugguacggccacauccugcugggcgagagccacggcagaauccugaagaccgaccugaagagcggcaacugcguggugcagugccagaccgagagaggcggccugaacaccacccugcccuuccacaacgugagcaaguacgccuucggcaacugccccaaguacaucggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgagaucaucgaccacgaguucagcgagaucgagaccagacugaacaugaucaacgacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgaccuguaccacaagugcgacaaccagugcauggagaccaucagaaacggcaccuacaacagaagaaaguaccaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162820 - RNA, 1683 nt, Artificial Sequence
  derived and/or modified sequence opt4 from hemagglutinin__InfluenzaA__AGQ81153
auggaggccgccaccaucaucaccauccugcuggugaucaccggcagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggcagaccccugauccuggacaccugcaccaucgagggccugaucuacggcaaccccagcugcgaccugccccuggagggcagagacuggagcuacaucguggagagacccagcgccgugaacggcgugugcuaccccggcaacguggagaaccuggaggagcugagaagccuguucagcagcgccagcagcuaccagaagauccagaucuuccccgacagcaucuggaacgugagcuacggcggcaucagcaaggccugcagcaacagcuucuacagaagcaugagauggcugacccagaagaacaacaacuaccccgugcaggacgcccaguacaccaacaacagaggcaagaacauccuguucauguggggcaucaaccacccccccaccaacaccacccagaccgaccuguacaccagaaccgacaccaccaccagcguggccaccgaggacauccacagaaccuucaagccccugaucggccccagaccccuggugaacggccugcagggcagaaucgacuacuacugggccgugcugaagcccggccagacccugagagugagaagcaacggcaaccugaucgcccccugguacggccacauccugcugggcaagagccacggcagaauccugaagaccgaccugaagagcggcaacugcguggugcagugccagaccgagagaggcggccugaacaccacccugcccuuccacaacgugagcaaguacgccuucggcaacugccccaaguacaucggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgagaucaucgaccacgaguucagcgagaucgagaccagacugaacaugaucaacgacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgaccuguaccacaagugcgacaaccagugcauggagaccaucagaaacggcaccuacaacagaagaaaguaccaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162821 - RNA, 1683 nt, Artificial Sequence
  derived and/or modified sequence opt4 from hemagglutinin__InfluenzaA__AGQ81155
auggaggccgccaccaucaucaccauccugcuggugaucaccggcagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggcagaccccugauccuggacaccugcaccaucgagggccugaucuacggcaaccccagcugcgaccugccccuggagggcagagacuggagcuacaucguggagagacccagcgccgugaacggcgugugcuaccccggcaacguggagaaccuggaggagcugagaagccuguucagcagcgccagcagcuaccagaagauccagaucuuccccgacagcaucuggaacgugagcuacaacggcaccagcaaggccugcagcgacagcuucuacagaagcaugagauggcugacccagaagaacaacaacuaccccgugcaggacgcccaguacaccaacaacagaggcaagaacauccuguucauguggggcaucaaccacccccccaccgacaccacccagaccaaccuguacaccagaaccgacaccaccaccagcguggccaccgaggacaucaacagaaccuucaagccccugaucggccccagaccccuggugaacggccugcagggcagaaucgacuacuacugggccgugcugaagcccggccagacccugagagugagaagcaacggcaaccugaucgcccccugguacggccacauccugcugggcgagagccacggcagaauccugaagaccgaccugaagagcggcaacugcguggugcagugccagaccgagagaggcggccugaacaccacccugcccuuccacaacgugagcaaguacgccuucggcgacugccccaaguacaucggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgagaucaucgaccacgaguucagcgagaucgagaccagacugaacaugaucaacgacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgaccuguaccacaagugcgacaaccagugcauggagaccaucagaaacggcaccuacaacagaagaaaguaccaggaggagagcagacuggagagacaggagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162822 - RNA, 1683 nt, Artificial Sequence
  derived and/or modified sequence opt4 from hemagglutinin__InfluenzaA__AGQ81156
auggaggccgccaccaucaucaccauccugcuggugaucaccggcagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggcagaccccugauccuggacaccugcaccaucgagggccugaucuacggcaaccccagcugcgaccugccccuggagggcagagacuggagcuacaucguggagagacccagcgccgugaacggcgugugcuaccccggcaacguggagaaccuggaggagcugagaagccuguucagcagcgccagcagcuaccagaagauccagaucuuccccgacagcaucuggaacgugagcuacggcggcaucagcaaggccugcagcaacagcuucuacagaagcaugagauggcugacccagaagaacaacaacuaccccgugcaggacgcccaguacaccaacaacagaggcaagaacauccuguucauguggggcaucaaccacccccccaccaacaccacccagaccgaccuguacaccagaaccgacaccaccaccagcguggccaccgaggacauccacagaaccuucaagccccugaucggccccagaccccuggugaacggccugcagggcagaaucgacuacuacugggccgugcugaagcccggccagacccugagagugagaagcaacggcaaccugaucgcccccugguacggccacauccugcugggcgagagccacggcagaauccugaagaccgaccugaagagcggcaacugcguggugcagugccagaccgagagaggcggccugaacaccacccugcccuuccacaacgugagcaaguacgccuucggcaacugccccaaguacaucggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgagaucaucgaccacgaguucagcgagaucgagaccagacugaacaugaucaacgacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgaccuguaccacaagugcgacaaccagugcauggagaccaucagaaacggcaccuacaacagaagaaaguaccaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162823 - RNA, 1683 nt, Artificial Sequence
  derived and/or modified sequence opt4 from hemagglutinin__InfluenzaA__AGQ81157
auggaggccgccaccaucaucaccauccugcuggugaucaccggcaacaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggcagaccccugauccuggacaccugcaccaucgagggccugaucuacggcaaccccagcugcgaccugccccuggagggcagagacuggagcuacaucguggagagacccagcgccgugaacggcgugugcuaccccggcaacguggagaaccuggaggagcugagaagccuguucagcagcgccagcagcuaccagaagauccagaucuuccccgacagcaucuggaacgugagcuacaacggcaccagcaaggccugcagcgacagcuucuacagaagcaugagauggcugacccagaagaacaacaacuaccccgugcaggacgcccaguacaccaacaacagaggcaagaacauccuguucauguggggcaucaaccacccccccaccgacaccacccagaccaaccuguacaccagaaccgacaccaccaccagcguggccaccgaggacaucaacagaaccuucaagccccugaucggccccagaccccuggugaacggccugcagggcagaaucgacuacuacugggccgugcugaagcccggccagacccugagagugagaagcaacggcaaccugaucgcccccugguacggccacauccugcugggcgagagccacggcagaauccugaagaccgaccugaagagcggcaacugcguggugcagugccagaccgagagaggcggccugaacaccacccugcccuuccacaacgugagcaaguacgccuucggcgacugccccaaguacaucggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgagaucaucgaccacgaguucagcgagaucgagaccagacugaacaugaucaacgacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgaccuguaccacaagugcgacaaccagugcauggagaccaucagaaacggcaccuacaacagaagaaaguaccaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162824 - RNA, 1683 nt, Artificial Sequence
  derived and/or modified sequence opt4 from hemagglutinin__InfluenzaA__AGQ81158
auggagguggugaccaucaucaccauccugcuggugaucaccagaagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggcagaccccugauccuggacaccugcaccaucgagggccugaucuacggcaaccccagcugcgaccugccccuggagggcagagaguggagcuacaucguggagagacccagcgccgugaacggcgugugcuaccccggcaacguggagaaccuggaggagcugagaagccuguucagcagcgccagcagcuaccagagaauccagaucuuccccgacagcaucuggaacgugagcuacagcggcaccagcaaggccugcagcgacagcuucuacagaagcaugagauggcugacccagaagaacaacaacuaccccgugcaggacgcccaguacaccaacaacagaggcaagaacauccuguucauguggggcaucaaccacccccccaccgacaccgcccagaccaaccuguacaccagaaccgacaccaccaccagcguggccaccgaggacaucaacagaaccuucaagccccugaucggccccagaccccuggugaacggccugcagggcagaaucgacuacuacugggccgugcugaagcccggccagacccugagagugagaagcaacggcaaccugaucgcccccugguacggccacauccugcugggcgagagccacggcagaauccugaagaccgaccugaagagcggcagcugcguggugcagugccagaccgagagaggcggccugaacaccacccugcccuuccacaacgugagcaaguacgccuucggcaacugccccaaguacaucggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgagaucaucaaccacgaguucagcgagaucgagaccagacugaacaugaucaacgacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgaccuguaccacaagugcgacaaccagugcauggagaccaucagaaacggcaccuacaacagaagaauguaccaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162825 - RNA, 1683 nt, Artificial Sequence
  derived and/or modified sequence opt4 from hemagglutinin__InfluenzaA__AGQ81159
auggaggccgccaccaucaucaccauccugcuggugaucaccggcagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggcagaccccugauccuggacaccugcaccaucgagggccugaucuacggcaaccccagcugcgaccugccccuggagggcagagacuggagcuacaucguggagagacccagcgccgugaacggcgugugcuaccccggcaacguggagaaccuggaggagcugagaagccuguucagcagcgccagcagcuaccagaagauccagaucuuccccgacagcaucuggaacgugagcuacgacggcaucagcaaggccugcagcaacagcuucuacagaagcaugagauggcugaccaagaagaacaacagcuaccccgugcaggacgcccaguacaccaacaacaucggcaagaacauccuguucauguggggcaucaaccacccccccaccaacaccacccagaccgaccuguacaccagaaccgacaccaccaccagcguggccaccgaggacauccacagaaccuucaagccccugaucggccccagaccccccgugaacggccugcugggcagaaucgacuacuacugggccgugcugaagcccggccagacccugagagugagaagcaacggcaaccugaucgcccccugguacggccacauccugcugggcgagagccacggcagaauccugaagaccgaccugaagagcggcaacugcguggugcagugccagaccgagagaggcggccugaacaccacccugcccuuccacaacgugagcaaguacgccuucggcaacugccccaaguacaucggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcaccggcauggccgccgacagagacagcacccagaaggccaucgacaagaucaccagcaaggugaacaacaucguggacaagaugaacaagcaguacgagaucaucgaccacgaguucagcgagaucgagaccagacugaacaugaucaacgacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgaccuguaccacaagugcgacaaccagugcauggagaccaucagaaacggcaccuacaacagaagaaaguaccaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162826 - RNA, 1683 nt, Artificial Sequence
  derived and/or modified sequence opt4 from hemagglutinin__InfluenzaA__AGQ81161
auggagaccgugagccugaucaccauccugcugguggccaccgugagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccagccugggccagccccugauccuggacaccugcaccaucgagggccugaucuacggcaaccccagcugcgacccccugcuggagggcagagaguggagcuacaucguggagagacccagcgccgugaacggccugugcuaccccggcaacguggagaaccuggaggagcugagaagccuguucagcagcgccagaagcuaccagagaauccagaucuuccccgacaccaucuggaacgugagcuacgacggcaccagcaaggccugcagcggcagcuucuacagaaacaugagauggcugacccagaagaacagcgacuaccccauccaggacgcccaguacaccaacaaccagggcaagaacauccuguucauguggggcaucaaccacccccccaccgacaccacccagagagaccuguacaccagaaccgacaccaccaccagcguggccaccgaggagaucaacagaaucuucaagccccugaucggccccagaccccuggugaacggccugaugggcagaaucgacuacuacuggagcgugcugaagcccggccagacccugagaaucaagagcgacggcaaccugaucgcccccugguacggccacauccugagcggcgagagccacggcagaauccugaagaccgaccugaagaagggcagcugcaccgugcagugccagaccgagaagggcggccugaacaccacccugcccuuccagaacgugagcaaguacgccuucggcaacugcagcaaguacaucggcaucaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaagaaaguaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162827 - RNA, 1683 nt, Artificial Sequence
  derived and/or modified sequence opt4 from hemagglutinin__InfluenzaA__AGQ81162
auggagaccgugagccugaucaccauccugcugguggccaccgugagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccagccugggccagccccugauccuggacaccugcaccaucgagggccugaucuacggcaaccccagcugcgaccugcugcuggagggcagagaguggagcuacaucguggagagacccagcgccgugaacggccugugcuaccccggcaacguggagaaccuggaggagcugagaagccuguucagcagcgccagaagcuaccagagaauccagaucuuccccgacaccaucuggaacgugagcuacgacggcaccagcaaggccugcagcggcagcuucuacagaagcaugagauggcugacccagaagaacagcgacuaccccauccaggacgcccaguacaccaacaaccagggcaagaacauccuguucauguggggcaucaaccacccccccaccgacaccacccagagagaccuguacaccagaaccgacaccaccaccagcguggccaccgaggagaucaacagaaucuucaagccccugaucggccccagaccccuggugaacggccugaugggcagaaucgacuacuacuggagcgugcugaagcccggccagacccugagaaucaagagcgacggcaaccugaucgcccccugguacggccacauccugagcggcgagagccacggcagaauccugaagaccgaccugaagaagggcagcugcaccgugcagugccagaccgagaagggcggccugaacaccacccugcccuuccagaacgugagcaaguacgccuucggcaacugcagcaaguacaucggcaucaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaaagaaguaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162828 - RNA, 1683 nt, Artificial Sequence
  derived and/or modified sequence opt4 from hemagglutinin__InfluenzaA__AGQ81164
auggagaccgugagccugaucaccauccugcugguggccaccgugagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccagccugggccagccccugauccuggacaccugcaccaucgagggccugaucuacggcaaccccagcugcgaccugcugcuggagggcagagaguggagcuacaucguggagagacccagcgccgugaacggccugugcuaccccggcaacguggagaaccuggaggagcugagaagccuguucagcagcgccagaagcuaccagagaauccagaucuuccccgacaccaucuggaacgugagcuacgacggcaccagcaaggccugcagcggcagcuucuacagaagcaugagauggcugacccagaagaacagcgacuaccccauccaggacgcccaguacaccaacaaccagggcaagaacauccuguucauguggggcaucaaccacccccccaccgacaccacccagagagaccuguacaccagaaccgacaccaccaccagcguggccaccgaggagaucaacagaaucuucaagccccugaucggccccagaccccuggugaacggccugaugggcagaaucgacuacuacuggagcgugcugaagcccggccagacccugagaaucaagagcgacggcaaccugaucgcccccugguacggccacauccugagcggcgagagccacggcagaauccugaagaccgaccugaagaagggcagcugcaccgugcagugccagaccgagaagggcggccugaacaccacccugcccuuccagaacgugagcaaguacgccuucggcaacugcagcaaguacaucggcaucaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaagaaaguaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162829 - RNA, 1683 nt, Artificial Sequence
  derived and/or modified sequence opt4 from hemagglutinin__InfluenzaA__AGQ81167
auggagaccgugagccugaucaccauccugcugguggccaccgugagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccagccugggccagccccugauccuggacaccugcaccaucgagggccugaucuacggcaaccccagcugcgaccugcugcuggagggcagagaguggagcuacaucguggagagacccagcgccgugaacggccugugcuaccccggcaacguggagaaccuggaggagcugagaagccuguucagcagcgccagaagcuaccagagaauccagaucuuccccgacaccaucuggaacgugagcuacaacggcaccagcaaggccugcagcggcagcuucuacagaagcaugagauggcugacccagaagaacagcaacuaccccauccaggacgcccaguacaccaacaaccagggcaagaacauccuguucauguggggcaucaaccacccccccaccgacaccacccagagagaccuguacaccagaaccgacaccaccaccagcguggccaccgaggagaucaacagaaucuucaagccccugaucggccccagaccccuggugaacggccugaugggcagaaucgacuacuacuggagcgugcugaagcccggccagacccugagaaucaagagcgacggcaaccugaucgcccccugguacggccacauccugagcggcgagagccacggcagaauccugaagaccgaccugaagaagggcagcugcaccgugcagugccagaccgagaagggcggccugaacaccacccugcccuuccagaacgugagcaaguacgccuucggcaacugcagcaaguacaucggcaucaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaagaaaguaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162830 - RNA, 1683 nt, Artificial Sequence
  derived and/or modified sequence opt4 from hemagglutinin__InfluenzaA__AGQ81168
auggagaccgugagccugaucaccauccugcugguggugaccgugagcaacgccgacaagaucugcaucggcuaccagagcaccaacagcaccgagaccguggacacccugaccgagaacaacgugcccgugacccacgccagagagcugcugcacaccgagcacaacggcaugcugugcgccaccagccugggccacccccugauccuggacaccugcaccaucgagggccugaucuacggcaaccccagcugcgaccugcugcugggcggcagagaguggagcuacaucguggagagacccagcgccgugaacggccugugcuaccccggcaacguggagaaccuggaggagcugagaagccuguucagcagcgccagaagcuaccagagaauccagaucuuccccgacaccaucuggaacgugagcuacagcggcaccagcaaggccugcagcgacagcuucuacagaagcaugagauggcugacccagaagggcaacgccuaccccauccaggacgcccaguacaccaacaaccagggcaagaacauccuguucauguggggcaucaaccacccccccaccgacaccgcccagaccaaccuguacaccagaaccgacaccaccaccagcguggccaccgaggagaucaacagaaccuucaagccccugaucggccccagaccccuggugaacggccugaugggcagaaucaacuacuacuggagcgugcugaagcccggccagacccugagaaucaagagcaacggcaaccugaucgcccccugguacggccacauccugagcggcgagagccacggcagaauccugaagaccgaccugaagagaggcagcugcaccgugcagugccagaccgagaagggcggccugaacaccacccugcccuuccagaacgugagcaaguacgccuucggcaacugcagcaaguacaucggcaugaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaagaaaguaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162831 - RNA, 1683 nt, Artificial Sequence
  derived and/or modified sequence opt4 from hemagglutinin__InfluenzaA__AGQ81169
auggagaccgugagccugaucaccauccugcugguggugaccgugagcaacgccgacaagaucugcaucggcuaccagagcaccaacagcaccgagaccguggacacccugaccgagaacaacgugcccgugacccacgccagagagcugcugcacaccgagcacaacggcaugcugugcgccaccagccugggccacccccugauccuggacaccugcaccaucgagggccugaucuacggcaaccccagcugcgaccugcugcugggcggcagagaguggagcuacaucguggagagacccagcgccgugaacggccugugcuaccccggcaacguggagaaccuggaggagcugagaagccuguucagcagcgccagaagcuaccagagaauccagaucuuccccgacaccaucuggaacgugagcuacagcggcaccagcaaggccugcagcgacagcuucuacagaagcaugagauggcugacccagaaggacaacgccuaccccauccaggacgcccaguacaccaacaaccaggagaagaacauccuguucauguggggcaucaaccacccccccaccgacaccgugcagaccaaccuguacaccagaaccgacaccaccaccagcguggccaccgaggagaucaacagaaccuucaagccccugaucggccccagaccccuggugaacggccugaugggcagaaucaacuacuacuggagcgugcugaagcccggccagacccugagaaucaagagcaacggcaaccugaucgcccccugguacggccacauccugagcggcgagagccacggcagaauccugaagaccgaccugaagagaggcagcugcaccgugcagugccagaccgagaagggcggccugaacaccacccugcccuuccagaacgugagcaaguacgccuucggcaacugcagcaaguacaucggcaugaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaagaaaguaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162832 - RNA, 1683 nt, Artificial Sequence
  derived and/or modified sequence opt4 from hemagglutinin__InfluenzaA__AGQ81170
auggagaccgugagccugaucaccauccugcugguggugaccgugagcaacgccgacaagaucugcaucggcuaccagagcaccaacagcaccgagaccguggacacccugaccgagaacaacgugcccgugacccacgccagagagcugcugcacaccgagcacaacggcaugcugugcgccaccagccugggccacccccugauccuggacaccugcaccaucgagggccugaucuacggcaaccccagcugcgaccugcugcugggcggcagagaguggagcuacaucguggagagacccagcgccgugaacggccugugcuaccccggcaacguggagaaccuggaggagcugagaagccuguucagcagcgccagaagcuaccagagaauccagaucuuccccgacaccaucuggaacgugagcuacagcggcaccagcaaggccugcagcgacagcuucuacagaagcaugagauggcugacccagaaggacaacgccuaccccauccaggacgcccaguacaccaacaaccagggcaagaacauccuguucauguggggcaucaaccacccccccaccgacaccgcccagaccaaccuguacaccagaaccgacaccaccaccagcguggccaccgaggagaucaacagaaccuucaagccccugaucggccccagaccccuggugaacggccugaugggcagaaucaacuacuacuggagcgugcugaagcccggccagacccugagaaucaagagcaacggcaaccugaucgcccccugguacggccacauccugagcggcgagagccacggcagaauccugaagaccgaccugaagagaggcagcugcaccgugcagugccagaccgagaagggcggccugaacaccacccugcccuuccagaacgugagcaaguacgccuucggcaacugcagcaaguacaucggcaugaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaagaaaguaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162833 - RNA, 1683 nt, Artificial Sequence; identical to SEQ ID NO: 162832
  derived and/or modified sequence opt4 from hemagglutinin__InfluenzaA__AGQ81171

SEQ ID NO: 162834 - RNA, 1683 nt, Artificial Sequence; identical to SEQ ID NO: 162832
  derived and/or modified sequence opt4 from hemagglutinin__InfluenzaA__AGQ81172

SEQ ID NO: 162835 - RNA, 1683 nt, Artificial Sequence
  derived and/or modified sequence opt4 from hemagglutinin__InfluenzaA__AGQ81173
auggagaccgccagccugaucaccauccugcugguggugaccgugagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccagccugggcaacccccugauccuggacaccugcaccaucgagggccugaucuacggcaaccccagcugcgaccugcugcugggcggcagagaguggagcuacaucguggagagacccagcgccgugaacggccugugcuaccccggcaacguggagaaccuggaggagcugagaagccuguucagcagcgccagaagcuaccagagaauccagaucuuccccgacaccaucuggaacgugagcuacagcggcaccagcaaggccugcagcgacagcuucuacagaagcaugagauggcugacccagaaggacaacgccuaccccauccaggacgcccaguacaccaacaaccagggcaagaacauccuguucauguggggcaucaaccacccccccaccgacaccgcccagaccaaccuguacaccagaaccgacaccaccaccagcguggccaccgaggagaucaacagaaccuucaagccccugaucggccccagaccccuggugaacggccugaugggcagaaucaacuacuacuggagcgugcugaagcccggccagacccugagaaucaagagcaacggcaaccugaucgcccccugguacggccacauccugagcggcgagagccacggcagaauccugaagaccgaccugaagagaggcagcugcaccgugcagugccagaccgagaagggcggccugaacaccacccugcccuuccagaacgugagcaaguacgccuucggcaacugcagcaaguacaucggcaugaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaagaaaguaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162836 - RNA, 1683 nt, Artificial Sequence; identical to SEQ ID NO: 162832
  derived and/or modified sequence opt4 from hemagglutinin__InfluenzaA__AGQ81175

SEQ ID NO: 162837 - RNA, 1683 nt, Artificial Sequence
  derived and/or modified sequence opt4 from hemagglutinin__InfluenzaA__AGQ81177
auggagaccgugagccugaucaccauccugcugguggccaccgugagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccagccugggccagccccugauccuggacaccugcaccaucgagggccugaucuacggcaaccccagcugcgaccugcugcuggagggcagagaguggagcuacaucguggagagacccagcgccgugaacggccugugcuaccccggcaacguggagaaccuggaggagcugagaagccuguucagcagcgccagaagcuaccagagaauccagaucuuccccgacaccaucuggaacgugagcuacaacggcaccagcaaggccugcagcggcagcuucuacagaagcaugagauggcugaccagaaagaacggcgacuaccccauccaggacgcccaguacaccaacaaccagggcaagaacauccuguucauguggggcaucaaccacccccccaccgacaccacccagagagaccuguacaccagaaccgacaccaccaccagcguggccaccgaggagaucaacagaaucuucaagccccugaucggccccagaccccuggugaacggccugaugggcagaaucgacuacuacuggagcgugcugaagcccggccagacccugagaaucaagagcgacggcaaccugaucgcccccugguacggccacauccugagcggcgagagccacggcagaauccugaagaccgaccugaagagaggcagcugcaccgugcagugccagaccgagaagggcggccugaacaccacccugcccuuccagaacgugagcaaguacgccuucggcaacugcagcaaguacaucggcaucaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaagaaaguaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162838 - RNA, 1683 nt, Artificial Sequence; identical to SEQ ID NO: 162837
  derived and/or modified sequence opt4 from hemagglutinin__InfluenzaA__AGQ81178

SEQ ID NO: 162839 - RNA, 1683 nt, Artificial Sequence; identical to SEQ ID NO: 162829
  derived and/or modified sequence opt4 from hemagglutinin__InfluenzaA__AGQ81181

SEQ ID NO: 162840 - RNA, 1683 nt, Artificial Sequence; identical to SEQ ID NO: 162829
  derived and/or modified sequence opt4 from hemagglutinin__InfluenzaA__AGQ81183

SEQ ID NO: 162841 - RNA, 1683 nt, Artificial Sequence; identical to SEQ ID NO: 162828
  derived and/or modified sequence opt4 from hemagglutinin__InfluenzaA__AGQ81184

SEQ ID NO: 162842 - RNA, 1683 nt, Artificial Sequence
  derived and/or modified sequence opt4 from hemagglutinin__InfluenzaA__AGQ81185
auggagaccgccagccugaucaccauccugcugguggccaccgugagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccagccugggccagccccugauccuggacaccugcaccaucgagggccugaucuacggcaaccccagcugcgaccugcugcuggagggcagagaguggagcuacaucguggagagacccagcgccgugaacggccugugcuaccccggcaacguggagaaccuggaggagcugagaagccuguucagcagcgccagaagcuaccagagaauccagaucuuccccgacaccaccuggaacgugagcuacaacggcaccagcaaggccugcagcggcagcuucuacagaagcaugagauggcugacccagaagaacagcaacuaccccauccaggacgcccaguacaccaacaaccagggcaagaacauccuguucauguggggcaucaaccacccccccaccgacaccacccagagagaccuguacaccagaaccgacaccaccaccagcguggccaccgaggagaucaacagaaucuucaagccccugaucggccccagaccccuggugaacggccugaugggcagaaucgacuacuacuggagcgugcugaagcccggccagacccugagaaucaagagcgacggcaaccugaucgcccccugguacggccacauccugagcggcgagagccacggcagaauccugaagaccgaccugaagagaggcagcugcaccgugcagugccagaccgagaagggcggccugaacaccacccugcccuuccagaacgugagcaaguacgccuucggcaacugcagcaaguacaucggcaucaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacaaccagugcauggagaccaucagaaacggcaccuacaacagaagaaaguaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162843 - RNA, 1683 nt, Artificial Sequence
  derived and/or modified sequence opt4 from hemagglutinin__InfluenzaA__AGQ81186
auggagaccgugagccugaucaccauccugcugguggccaccgugagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccagccugggccagccccugauccuggacaccugcaccaucgagggccugaucuacggcaaccccagcugcgaccugcugcuggagggcagagaguggagcuacaucguggagagacccagcgccgugaacggccugugcuaccccggcaacguggagaaccuggaggagcugagaagccuguucagcagcgccagaagcuaccagagaauccagaucuuccccgacaccaucuggaacgugagcuacgacggcaccagcaaggccugcagcggcagcuucuacagaagcaugagauggcugacccagaagaacagcgacuaccccauccaggacgcccaguacaccaacaaccagggcaagaacauccuguucauguggggcaucaaccacccccccaccgacaccacccagagagaccuguacaccagaaccgacaccaccaccagcguggccaccgaggagaucaacagaaucuucaagccccugaucggccccagaccccuggugaacggccugaugggcagaaucgacuacuacuggagcgugcugaagcccggccagacccugagaaucaagagcgacggcaaccugaucgcccccugguacggccacauccugagcggcgagagccacggcagaauccugaagaccgaccugaagaagggcagcugcaccgugcagugccagaccgagaagggcggccugaacaccacccugcccuuccagaacgugagcaaguacgccuucggcaacugcagcaaguacaucggcaucaagagccugaagcuggccaucggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaaagaaguaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162844 - RNA, 1683 nt, Artificial Sequence; identical to SEQ ID NO: 162832
  derived and/or modified sequence opt4 from hemagglutinin__InfluenzaA__AGQ81190

SEQ ID NO: 162845 - RNA, 1683 nt, Artificial Sequence; identical to SEQ ID NO: 162832
  derived and/or modified sequence opt4 from hemagglutinin__InfluenzaA__AGQ81191

SEQ ID NO: 162846 - RNA, 1683 nt, Artificial Sequence; identical to SEQ ID NO: 162837
  derived and/or modified sequence opt4 from hemagglutinin__InfluenzaA__AGQ81192

SEQ ID NO: 162847 - RNA, 1683 nt, Artificial Sequence
  derived and/or modified sequence opt4 from hemagglutinin__InfluenzaA__AGQ81193
auggagaccgugagccugaucaccauccugcugguggccaccgugagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccagccugggccagccccugauccuggacaccugcaccaucgagggccugaucuacggcaaccccagcugcgaccugcugcuggagggcagagaguggagcuacaucguggagagacccagcgccgugaacggccugugcuaccccggcaacguggagaaccuggaggagcugagaagccuguucagcagcgccagaagcuaccagagaauccagaucuuccccgacaccaucuggaacgugagcuacaccggcaccagcaaggccugcagcggcagcuucuacagaagcaugagauggcugacccagaagaacggcgacuaccccauccaggacgcccaguacaccaacaaccagggcaagaacauccuguucauguggggcaucaaccacccccccaccgacaccacccagagagaccuguacaccagaaccgacaccaccaccagcguggccaccgaggagaucaacagaaucuucaagccccugaucggccccagaccccuggugaacggccugaugggcagaaucgacuacuacuggagcgugcugaagcccggccagacccugagaaucaagagcgacggcaaccugaucgcccccugguacggccacgugcugagcggcgagagccacggcagaauccugaagaccgaccugaagagaggcagcugcaccgugcagugccagaccgagaagggcggccugaacaccacccugcccuuccagaacgugagcaaguacgccuucggcaacugcagcaaguacaucggcaucaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaagaaaguaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162848 - RNA, 1683 nt, Artificial Sequence; identical to SEQ ID NO: 162832
  derived and/or modified sequence opt4 from hemagglutinin__InfluenzaA__AGQ81194

SEQ ID NO: 162849 - RNA, 1686 nt, Artificial Sequence
  derived and/or modified sequence opt4 from hemagglutinin__InfluenzaA__AGQ81195
auguacaagaucguggugaucaucacccugcugggcaccgugaagggccuggacaagaucugccugggccaccacgccguggccaacggcaccaucgugaagacccugaccaacgagcaggaggaggugaccaacgccaccgagaccguggagggcaagagccugaacagacugugcaugaagggcagaaaccacaaggaccugggcaacugccaccccaucggcaugcugaucggcacccccgccugcgaccugcaccugaccggcaccugggacacccugaucgagagagagaacgccaucgccuacugcuaccccggcgccaccaucaacgaggaggcccugagacagaagaucauggagagcggcggcaucagcaagaucagcaccggcuucaccuacggcagcagcaucaacagcgccggcaccaccagagccugcaugagaaacggcggcaacagcuucuacgccgagcugaaguggcuggugagcaagagcaagggccagaacuucccccagaccaccaacaccuacagaaacaccgacaccagcgagcaccugaucauguggggcauccaccaccccagcagcacccaggagaagaacgaccuguacggcacccagagccugagcaucagcgugggcagcagcaccuaccagaacaacuucgugcccguggugggcgccagaccccaggugaacggccagagcggcagaaucgacuuccacuggacccuggugcagcccggcgacaacaucaccuucagccacaacggcggccugaucgcccccagcagagugagcaagcugaucggcagaggccugggcauccagagcgacgccagcaucgacaacaacugcgagagcaagugcuucuggagaggcggcagcaucaacaccagacugcccuuccagaaccugagccccagaaccgugggccagugccccaaguacgugaacaagagaagccugaugcuggccaccggcaugagaaacgugcccgagaucaugcagggcagaggccuguucggcgccaucgccggcuucaucgagaacggcugggagggcaugguggacggcugguacggcuucagacaccagaacgcccagggcaccggccaggccgccgacuacaagagcacccaggccgccaucgaccagaucaccggcaagcugaacagacugaucgagaagaccaacaccgaguucgagagcaucgagagcgaguucagcgagaucgagcaccagaucggcaacgugaucaacuggaccaaggacagcaucaccgacaucuggaccuaccaggccgagcugcugguggccauggagaaccagcacaccaucgacauggccgacagcgagaugcugaaccuguacgagagagugagaaagcagcugagacagaacgccgaggaggacggcaagggcugcuucgagaucuaccacgccugcgacgacagcugcauggagagcaucagaaacaacaccuacgaccacagccaguacagagaggaggcccugcugaacagacugaacaucaaccccgugacccugagcagcggcuacaaggacaucauccugugguucagcuucggcgccagcugcuucgugcugcuggccguggugaugggccugguguucuucugccugaagaacggcaacaugagaugcaccaucugcaucuga

SEQ ID NO: 162850 - RNA, 1686 nt, Artificial Sequence
  derived and/or modified sequence opt4 from hemagglutinin__InfluenzaA__AGQ81196
auguacaagaucguggugaucaucgcccugcugggcgccgugaagggccuggacaagaucugccugggccaccacgccguggccaacggcaccaucgugaagacccugaccaacgagcaggaggaggugaccaacgccaccgagaccguggagagcgccagccugaacagacugugcaugaagggcagaagccacaaggaccugggcaacugccaccccaucggcaugcugaucggcacccccgccugcgaccugcaccugaccggcaccugggacacccugaucgagagagagaacgccaucgccuacugcuaccccggcgccaccgugaacgaggaggcccugagacagaagaucauggagagcggcggcaucagcaagaucagcaccggcuucaccuacggcagcagcaucaacagcgccggcaccaccaaggccugcaugagaaacagaggcaacagcuucuacgccgagcugaaguggcuggugagcaagagcaagggccagaacuucccccagaccaccaacaccuacagaaacaccgacaccgccgagcaccugaucauguggggcauccaccaccccagcagcacccaggagaagaacgaccuguacggcacccagagccugagcaucagcgugggcagcagcaccuaccagaacaacuucgugcccguggugggcgccagaccccaggugaacggccagagcggcagaaucgacuuccacuggacccuggugcagcccggcgacaacaucaccuucagccacaacggcggccugaucgcccccagcagagugagcaagcuggugggcagaggccugggcauccagagcgacgcccccaucgacaacaacugcgagagcaagugcuucuggagaggcggcagcaucaacaccagacugcccuuccagaaccugagccccagaaccgugggccagugccccaaguacgugaacaagagaagccugaugcuggccaccggcaugagaaacgugcccgagaucaugcagggcagaggccuguucggcgccaucgccggcuucaucgagaacggcugggagggcaugguggacggcugguacggcuucagacaccagaacgcccagggcaccggccaggccgccgacuacaagagcacccagaccgccaucgaccagaucaccggcaagcugaacagacugaucgagaagaccaacaccgaguucgagagcaucgagagcgaguucagcgagaucgagcaccagaucggcaacgugaucaacuggaccaaggacagcaucaccgacaucuggaccuaccaggccgagcugcugguggccauggagaaccagcacaccaucgacauggccgacagcgagaugcugaaccuguacgagagagugagaaagcagcugagacagaacgccgaggaggacggcaagggcugcuucgagaucuaccacgccugcgacgacagcugcauggagagcaucagaaacaacaccuacgaccacagccaguacagagaggaggcccugcugaacagacugaacaucaaccccgugaagcugagcagcggcuacaaggacaucauccugugguucagcuucggcgccagcugcuucgugcugcuggccguggugaugggccugguguucuucugccugaagaacggcaacaugagaugcaccaucugcaucuga

SEQ ID NO: 162851 - RNA, 1686 nt, Artificial Sequence
  derived and/or modified sequence opt4 from hemagglutinin__InfluenzaA__AGQ81198
auguacaagaucguggugaucaucgcccugcugggcgccgugaagggccuggacaagaucugccugggccaccacgccguggccaacggcaccaucgugaagacccugaccaacgagcaggaggaggugaccaacgccaccgagaccguggagagcaccagccugaacagacugugcaugaagggcagaaaccacaaggaccugggcaacugccaccccaucggcaugcugaucggcacccccgccugcgaccugcaccugaccggcaccugggacacccugaucgagagagagaacgccaucgccuacugcuaccccggcgccaccaucaacgaggaggcccugagacagaagaucauggagagcggcggcaucagcaagaucagcaccggcuucaccuacggcagcagcaucaacagcgccggcaacaccaaggccugcaugagaaacggcggcaacagcuucuacgccgagcugagauggcuggugagcaagaacaagggccagaacuucccccagaccaccaacaccuacagaaacaccgacaccgccgagcaccugaucaucuggggcauccaccaccccagcagcaccaaggagaagaacgaccuguacggcacccagagccugagcaucagcgugggcagcagcaccuaccagaacaacuucgugcccguggugggcgccagaccccaggugaacggccagagcggcagaaucgacuuccacuggacccuggugcagcccggcgacaacaucaccuucagccacaacggcggccugaucgcccccagcagagugagcaagcugaucggcagaggccugggcauccagagcgacgcccccaucgacaacaacugcgagagcaagugcuucuggagaggcggcagcaucaacaccagacugcccuuccagaaccugagccccagaaccgugggccagugccccaaguacgugaacaagaagagccugaugcuggccaccggcaugagaaacgugcccgagaucaugcagggcagaggccuguucggcgccaucgccggcuucaucgagaacggcugggagggcaugguggacggcugguacggcuucagacaccagaacgcccagggcaccggccaggccgccgacuacaagagcacccaggccgccaucgaccagaucaccggcaagcugaacagacugaucgagaagaccaacaccgaguucgagagcaucgagagcgaguucagcgagaucgagcaccagaucggcaacgugaucaacuggaccaaggacagcaucaccgacaucuggaccuaccaggccgagcugcugguggccauggagaaccagcacaccaucgacauggccgacagcgagaugcugaaccuguacgagagagugagaaagcagcugagacagaacgccgaggaggacggcaagggcugcuucgagaucuaccacgccugcgacgacagcugcauggagagcaucagaaacaacaccuacgaccacagccaguacagagaggaggcccugcugaacagacugaacaucaaccccgugacccugagcagcggcuacaaggacaucauccugugguucagcuucggcgccagcugcuucgugcugcuggccguggugaugggccugguguucuucugccugaagaacggcaacaugagaugcaccaucugcaucuga

SEQ ID NO: 162852 - RNA, 1686 nt, Artificial Sequence
  derived and/or modified sequence opt4 from hemagglutinin__InfluenzaA__AGQ81199
auguacaagaucguggugaucaucgcccugcugggcgccgugaagggccuggacaagaucugccugggccaccacgccguggccaacggcaccaucgugaagacccugaccaacgagcaggaggaggugaccaacgccaccgagaccguggagagcgccagccugaacagacugugcaugaagggcagaagccacaaggaccugggcaacugccaccccaucggcaugcugaucggcacccccgccugcgaccugcaccugaccggcaccugggacacccugaucgagagagagaacgccaucgccuacugcuaccccggcgccaccgugaacgaggaggcccugagacagaagaucauggagagcggcggcaucagcaagaucagcaccggcuucaccuacggcagcagcaucaacagcgccggcaccaccaaggccugcaugagaaacggcggcaacagcuucuacgccgagcugaaguggcuggugagcaagagcaagggccagaacuucccccagaccaccaacaccuacagaaacaccgacaccgccgagcaccugaucauguggggcauccaccaccccagcagcacccaggagaagaacgaccuguacggcacccagagccugagcaucagcgugggcagcagcaccuaccagaacaacuucgugcccguggugggcgccagaccccaggugaacggccagagcggcagaaucgacuuccacuggacccuggugcagcccggcgacaacaucaccuucagccacaacggcggccugaucgcccccagcagagugagcaagcuggugggcagaggccugggcauccagagcgacgcccccaucgacaacaacugcgagagcaagugcuucuggagaggcggcagcaucaacaccagacugcccuuccagaaccugagccccagaaccgugggccagugccccaaguacgugaacaagagaagccugaugcuggccaccggcaugagaaacgugcccgagaucaugcagggcagaggccuguucggcgccaucgccggcuucaucgagaacggcugggagggcaugguggacggcugguacggcuucagacaccagaacgcccagggcaccggccaggccgccgacuacaagagcacccagaccgccaucgaccagaucaccggcaagcugaacagacugaucgagaagaccaacaccgaguucgagagcaucgagagcgaguucagcgagaucgagcaccagaucggcaacgugaucaacuggaccaaggacagcaucaccgacaucuggaccuaccaggccgagcugcugguggccauggagaaccagcacaccaucgacauggccgacagcgagaugcugaaccuguacgagagagugagaaagcagcugagacagaacgccgaggaggacggcaagggcugcuucgagaucuaccacgccugcgacgacagcugcauggagagcaucagaaacaacaccuacgaccacagccaguacagagaggaggcccugcugaacagacugaacaucaaccccgugaagcugagcagcggcuacaaggacaucauccugugguucagcuucggcgccagcugcuucgugcugcuggccguggugaugggccugguguucuucugccugaagaacggcaacaugagaugcaccaucugcaucuga

SEQ ID NO: 162853 - RNA, 1698 nt, Artificial Sequence
  derived and/or modified sequence opt4 from hemagglutinin__InfluenzaA__AGQ81200
augaagaagacccugcuguucgccgccaucuuccuguacgugaaggccgacgagaucugcaucggcuaccugagcaacaacagcaccgacaagguggacaccaucaucgagaacaacgugaccgugaccagcagcguggagcugguggagaccgagcacaccggcagcuucugcagcaucaacggcaagcagcccaucggccugggcgacugcagcuucgccggcuggauccugggcaaccccaugugcgacgaccugaucggcaagaccagcuggagcuacaucguggagaagcccaaccccgccaacggcaucugcuaccccggcacccuggagaacgaggaggagcugagacugaaguucagcggcgugcuggaguucagcaaguucgaggccuucaccagcaccggcuggggcgccgugaacagcggcgccggcgugaccgccgccugcaaguucggcagcagcaacagcuucuucagaaacaugguguggcugauccaccagagcggcaccuaccccgugaucaagagaaccuucaacaacaccaagggcagagacgugcuggugguguggggcauccaccaccccgccacccugaaggagcaccaggaccuguacaagaaggacagcagcuacguggccgugggcagcgagaccuacaacagaagauucauccccgagaucagcaccagacccaaggugaacggccaggccggcagaaugaccuucuacuggaccaucgugaagcccggcgagagcaucaccuucgagagcaacggcgccuuccuggcccccagauacgccuucgagaucgugagcgugggcaacggcaagcuguucagaagcgagcugaacaucgagagcugcagcaccaagugccagaccgagaucggcggcaucaacaccaacaagagcuuccacagcgugcacagaaacaccaucggcgacugccccaaguacgugaacgugaagagccugaagcuggccaccggccugagaaacgugcccgccaucgccagcagaggccuguucggcgccaucgccggcuucaucgagggcggcuggcccggccugaucaacggcugguacggcuuccagcacagaaacgaggagggcaccggcaucgccgccgacaaggagagcacccagaaggccaucgaccagaucaccagcaaggugaacaacaucguggacaagaugaacaccaacuucgagagcgugcagcacgaguucagcgagaucgaggagagaaucaaccagcugagcaagcacguggacgacagcgugguggacaucuggagcuacaacgcccagcugcuggugcugcuggagaacgagaagacccuggaccugcacgacagcaacgugagaaaccugcacgagaaggugagaagaaugcugaaggacaacgccaaggacgagggcaacggcugcuucaccuucuaccacaagugcgacaacgagugcaucgagagagugagaaacggcaccuacgaccacaaggaguucgaggaggagagcaagaucaacagacaggagaucgagggcgugaagcuggacagcagcggcaacguguacaagauccugagcaucuacagcugcaucgccagcagccuggugcuggccgcccugaucaugggcuucauccugugggccugcagcaacggcagcugcagaugcaccaucugcaucuga

SEQ ID NO: 162854 - RNA, 1698 nt, Artificial Sequence
  derived and/or modified sequence opt4 from hemagglutinin__InfluenzaA__AGQ81202
augaagaagacccugcuguucgccgccaucuuccuguacgugaaggccgacgagaucugcaucggcuaccugagcaacaacagcaccgacaagguggacaccaucaucgagaacaacgugaccgugaccagcagcguggagcugguggagaccgagcacaccggcagcuucugcagcaucaacggcaagcagcccaucagccugggcgacugcagcuucgccggcuggauccugggcaaccccaugugcgacgaccugaucggcaagaccagcuggagcuacaucguggagaagcccaaccccgccaacggcaucugcuaccccggcacccuggagaacgaggaggagcugagacugaaguucagcggcgugcuggaguucagcaaguucgaggccuucaccagcaacggcuggggcgccgugaacagcggcgccggcgugaccgccgccugcaaguucggcagcagcaacagcuucuucagaaacaccguguggcugauccaccagagcggcaccuaccccgugaucaagagaaccuucaacaacaccaagggcagagacgugcuggugguguggggcgugcaccaccccgccacccugaaggagcaccaggaccuguacaagaaggacagcagcuacguggccgugggcagcgagaccuacaacagaagauucauccccgagaucagcaccagacccaaggugaacggccaggccggcagaaugaccuucuacuggaccaucgugaagcccggcgagagcaucaccuucgagagcaacggcgccuuccuggcccccagauacgccuucgagaucgugagcgugggcaacggcaagcuguucagaagcgagcugaacaucgagagcugcagcaccaagugccagaccgagaucggcggcaucaacaccaacaagagcuuccacagcgugcacagaaacaccaucggcgacugccccaaguacgugaacgugaagagccugaagcuggccaccggccugagaaacgugcccgccaucgccagcagaggccuguucggcgccaucgccggcuucaucgagggcggcuggcccggccugaucaacggcugguacggcuuccagcacagaaacgaggagggcaccggcaucgccgccgacaaggagagcacccagaaggccaucgaccagaucaccagcaaggugaacaacaucguggacagaaugaacaccaacuucgagagcgugcagcacgagagcagcgagaucgaggagagaaucaaccagcugagcaagcacguggacgacagcaugguggacaucuggagcuacaacgcccagcugcuggugcugcuggagaacgagaagacccuggaccugcacgacagcaacgugagaaaccugcacgagaaggugagaagaaugcugaaggacaacgccaaggacgagggcaacggcugcuucaccuucuaccacaagugcgacaacaagugcaucgagagagugagaaacggcaccuacgaccacaaggaguucgaggaggagagcaagaucaacagacaggagaucgagggcgugaagcuggacagcagcggcaacguguacaagauccugagcaucuacagcugcaucgccagcagccuggugcuggccgcccugaucaugggcuucauccugugggccugcagcaacggcagcugcagaugcaccaucugcaucuga

SEQ ID NO: 162855 - RNA, 1698 nt, Artificial Sequence
  derived and/or modified sequence opt4 from hemagglutinin__InfluenzaA__AGQ81203
augaagaagacccugcuguucgccgccaucuuccuguacgugaaggccgacgagaucugcaucggcuaccugagcaacaacagcaccgacaagguggacaccaucaucgagaacaacgugaccgugaccagcagcguggagcugguggagaccgagcacaccggcagcuucugcagcaucaacggcaagcagcccaucagccugggcgacugcagcuucgccggcuggauccugggcaaccccaugugcgacgaccugaucggcaagaccagcuggagcuacaucguggagaagcccaaccccgccaacggcaucugcuaccccggcacccuggagaacgaggaggagcugagacugaaguucagcggcgugcuggaguucaacaaguucgaggccuucaccagcaacggcuggggcgccgugaacagcggcgccggcgugaccgccgccugcaaguucggcagcagcaacagcuucuucagaaacaugguguggcugauccaccagagcggcaccuaccccgugaucaagagaaccuucaacaacaccaagggcagagacgugcuggugguguggggcauccaccaccccgccacccugaaggagcaccaggaccuguacaagaaggacagcagcuacguggccgugggcagcgagaccuacaacagaagauucauccccgagaucagcaccagacccaaggugaacggccaggccggcagaaugaccuucuacuggaccaucgugaagcccggcgagagcaucaccuucgagagcaacggcgccuuccuggcccccagauacgccuucgagaucgugagcgugggcaacggcaagcuguucagaagcgagcugaacaucgagagcugcagcaccaagugccagaccgagaucggcggcaucaacaccaacaagagcuuccacagcgugcacagaaacaccaucggcgacugccccaaguacgugaacgugaagagccugaagcuggccaccggccugagaaacgugcccgccaucgccagcagaggccuguucggcgccaucgccggcuucaucgagggcggcuggcccggccugaucaacggcugguacggcuuccagcacagaaacgaggagggcaccggcaucgccgccgacaaggagagcacccagaaggccaucgaccagaucaccagcaaggugaacaacaucguggacagaaugaacaccaacuucgagagcgugcagcacgaguucagcgagaucgaggagagaaucaaccagcugagcaagcacguggacgacagcgugguggacaucuggagcuacaacgcccagcugcuggugcugcuggagaacgagaagacccuggaccugcacgacagcaacgugagaaaccugcacgagaaggugagaagaaugcugaaggacaacgccaaggacgagggcaacggcugcuucaccuucuaccacaagugcgacaacgagugcaucgagagagugagaaacggcaccuacgaccacaaggaguucgaggaggagagcaagaucaacagacaggagaucgagggcgugaagcuggacagcagcggcaacguguacaagauccugagcaucuacagcugcaucgccagcagccuggugcuggccgcccugaucaugggcuucauccugugggccugcagcaacggcagcugcagaugcaccaucugcaucuga

SEQ ID NO: 162856 - RNA, 1698 nt, Artificial Sequence
  derived and/or modified sequence opt4 from hemagglutinin__InfluenzaA__AGQ81204
augaagaagacccugcuguucgccgccaucuuccuguacgugaaggccgacgagaucugcaucggcuaccugagcaacaacagcaccgacaagguggacaccaucaucgagaacaacgugaccgugaccagcagcguggagcugguggagaccgagcacaccggcagcuucugcagcaucaacggcaagcagcccaucagccugggcgacugcagcuucgccggcuggauccugggcaaccccaugugcgacgaccugaucggcaagaccagcuggagcuacaucguggagaagcccaaccccgccaacggcaucugcuaccccggcacccuggagaacgaggaggagcugagacugaaguucagcggcgugcuggaguucaacaaguucgaggccuucaccagcaacggcuggggcgccgugaacagcggcgccggcgugaccgccgccugcaaguucggcagcagcaacagcuucuucagaaacaugguguggcugauccaccagagcggcaccuaccccgugaucaagagaaccuucaacaacaccaagggcagagacgugcuggugguguggggcauccaccaccccgccacccugaaggagcaccaggaccuguacaagaaggacagcagcuacguggccgugggcagcgagaccuacaacagaagauucauccccgagaucagcaccagacccaaggugaacggccaggccggcagaaugaccuucuacuggaccaucgugaagcccggcgagagcaucaccuucgagagcaacggcgccuuccuggcccccagauacgccuucgagaucgugagcgugggcaacggcaagcuguucagaagcgagcugaacaucgagagcugcagcaccaagugccagaccgagaucggcggcaucaacaccaacaagagcuuccacagcgugcacagaaacaccaucggcgacugccccaaguacgugaacgugaagagccugaagcuggccaccggccugagaaacgugcccgccaucgccagcagaggccuguucggcgccaucgccggcuucaucgagggcggcuggcccggccugaucaacggcugguacggcuuccagcacagaaacgaggagggcaccggcaucgccgccgacaaggagagcacccagaaggccaucgaccagaucaccagcaaggugaacaacaucguggacagaaugaacaccaacuucggcagcgugcagcacgaguucagcgagaucgaggagagaaucaaccagcugagcaagcacguggacgacagcgugguggacaucuggagcuacaacgcccagcugcuggugcugcuggagaacgagaagacccuggaccugcacgacagcaacgugagaaaccugcacgagaaggugagaagaaugcugaaggacaacgccaaggacgagggcaacggcugcuucaccuucuaccacaagugcgacaacgagugcaucgagagagugagaaacggcaccuacgaccacaaggaguucgaggaggagagcaagaucaacagacaggagaucgagggcgugaagcuggacagcagcggcaacguguacaagauccugagcaucuacagcugcaucgccagcagccuggugcuggccgcccugaucaugggcuucauccugugggccugcagcaacggcagcugcagaugcaccaucugcaucuga

SEQ ID NO: 162857 - RNA, 1698 nt, Artificial Sequence
  derived and/or modified sequence opt4 from hemagglutinin__InfluenzaA__AGQ81205
augaagaagacccugcuguucgccgccaucuuccuguacgugaaggccgacgagaucugcaucggcuaccugagcaacaacagcaccgacaagguggacaccaucaucgagaacaacgugaccgugaccagcagcguggagcugguggagaccgagcacaccggcagcuucugcagcaucaacggcaagcagcccaucagccugggcgacugcagcuucgccggcuggauccugggcaaccccaugugcgacgaccugaucggcaagaccagcuggagcuacaucguggagaagcccaaccccgccaacggcaucugcuaccccggcacccuggagaacgaggaggagcugagacugaaguucagcggcgugcuggaguucaacaaguucgaggccuucaccagcaacggcuggggcgccgugaacagcggcgccggcgugaccgccaccugcaaguucggcagcagcaacagcuucuucagaaacaugguguggcugauccaccagagcggcaccuaccccgugaucaagagaaccuucaacaacaccaagggcagagacgugcuggugguguggggcauccaccaccccgccacccugaaggagcaccaggaccuguacaagaaggacagcagcuacguggccgugggcagcgagaccuacaacagaagauucauccccgagaucagcaccagacccaaggugaacggccaggccggcagaaugaccuucuacuggaccaucgugaagcccggcgagagcaucaccuucgagagcaacggcgccuuccuggcccccagauacgccuucgagaucgugagcgugggcaacggcaagcuguucagaagcgagcugaacaucgagagcugcagcaccaagugccagaccgagaucggcggcaucaacaccaacaagagcuuccacagcgugcacagaaacaccaucggcgacugccccaaguacgugaacgugaagagccugaagcuggccaccggccugagaaacgugcccgccaucgccagcagaggccuguucggcgccaucgccggcuucaucgagggcggcuggcccggccugaucaacggcugguacggcuuccagcacagaaacgaggagggcaccggcaucgccgccgacaaggagagcacccagaaggccaucgaccagaucaccagcaaggugaacaacaucguggacagaaugaacaccaacuucgagagcgugcaguacgaguucagcgagaucgaggagagaaucaaccagcugagcaagcacguggacgacagcgugguggacaucuggagcuacaacgcccagcugcuggugcugcuggagaacgagaagacccuggaccugcacgacagcaacgugagaaaccugcacgagaaggugagaagaaugcugaaggacaacgccaaggacgagggcaacggcugcuucaccuucuaccacaagugcgacaacgagugcaucgagagagugagaaacggcaccuacgaccacaaggaguucgaggaggagagcaagaucaacagacaggagaucgagggcgugaagcuggacagcagcggcaacguguacaagauccugagcaucuacagcugcaucgccagcagccuggugcuggccgcccugaucaugggcuucauccugugggccugcagcaacggcagcugcagaugcaccaucugcaucuga

SEQ ID NO: 162858 - RNA, 1698 nt, Artificial Sequence
  derived and/or modified sequence opt4 from hemagglutinin__InfluenzaA__AGQ81206
augaagaagacccugcuguucgccgccaucuuccuguacgccaaggccgacgagaucugcaucggcuaccugagcaacaacagcaccgacaagguggacaccaucaucgagaacaacgugaccgugaccagcagcguggagcugguggagaccgagcacaccggcagcuucugcagcaucaacggcaagcagcccaucagccugggcgacugcagcuucgccggcuggauccugggcaaccccaugugcgacgaccugaucggcaagaccagcuggagcuacaucguggagaagcccaaccccgccaacggcaucugcuaccccggcacccuggagaacgaggaggagcugagaagcaaguucagcggcgugcuggaguucagcaaguucgaggccuucaccagcaacggcuggggcgccgugaacagcggcgccggcgugaccgccgccugcaaguucggcagcagcaacagcuucuucagaaacaugguguggcugauccaccagagcggcaccuaccccgugaucaagagaaccuucaacaacaccaagggcagagacgugcuggugguguggggcauccaccaccccgccacccugaaggagcaccaggaccuguacaagaaggacagcagcuacguggccgugggcagcgagaccuacaacagaagauucauccccgagaucagcaccagacccaaggugaacggccaggccggcagaaugaccuucuacuggaccaucgugaagcccgaggagagcaucaccuucgagagcaacggcgccuuccuggcccccagauacgccuucgagaucgugagcgugggcaacggcaagcuguucagaagcgagcugaacaucgagagcugcagcaccaagugccagaccgagaucggcggcaucaacaccaacaagagcuuccacagcgugcacagaaacaccaucggcgacugccccaaguacgugaacgugaagagccugaagcuggccaccggccugagaaacgugcccgccaucgccagcagaggccuguucggcgccaucgccggcuucaucgagggcggcuggcccggccugaucaacggcugguacggcuuccagcacagaaacgaggagggcaccggcaucgccgccgacaaggagagcacccagaaggccaucgaccagaucaccagcaaggugaacaacaucguggacagaaugaacaccaacuucgagagcgugcagcacgaguucagcgagaucgaggagagaaucaaccagcugagcaagcacguggacgacagcgugguggacaucuggagcuacaacgcccagcugcuggugcugcuggagaacgagaagacccuggaccugcacgacagcaacgugagaaaccugcacgagaaggugagaagaaugcugaaggacaacgccaaggacgagggcaacggcugcuucaccuucuaccacaagugcgacaacgagugcaucgagagagugagaaacggcaccuacgaccacaaggaguucgaggaggagagcaagaucaacagacaggagaucgagggcgugaagcuggacagcagcggcaacguguacaagauccugagcaucuacagcugcaucgccagcagccugauccuggccgcccugaucaugggcuucauccugugggccugcagcaacggcagcugcagaugcaccaucugcaucuga

SEQ ID NO: 162859 - RNA, 1698 nt, Artificial Sequence
  derived and/or modified sequence opt4 from hemagglutinin__InfluenzaA__AGQ81209
augaagaagacccugcuguucgccgccaucuuccuguacgugaaggccgacgagaucugcaucggcuaccugagcaacaacagcaccgacaagguggacaccaucaucgagaacaacgugaccgugaccagcagcguggagcugguggagaccgagcacaccggcagcuucugcagcaucaacggcaagcagcccaucagccugggcgacugcagcuucgccggcuggauccugggcaaccccaugugcgacgaccugaucggcaagaccagcuggagcuacaucguggagaagcccaaccccgccaacggcaucugcuaccccggcacccuggagaacgaggaggagcugagacugaaguucagcggcauccuggaguucagcaaguucgaggccuucaccagcaacggcuggggcgccgugaacagcggcgccggcgugaccgccgccugcaaguucggcagcagcaacagcuucuucagaaacaugguguggcugauccaccagagcggcaccuaccccgugaucaagagaaccuucaacaacaccaagggcagagacgugcugaucguguggggcauccaccaccccgccacccugaaggagcaccaggaccuguacaagaaggacagcagcuacguggccgugggcagcgagaccuacaacagaagauucauccccgagaucagcaccagacccaaggugaacggccaggccggcagaaugaccuucuacuggaccaucgugaagcccggcgagagcaucaccuucgagagcaacggcgccuuccuggcccccagauacgccuucgagaucgugagcgugggcaacggcaagcuguucagaagcgagcugaacaucgagagcugcagcaccaagugccagaccgagaucggcggcaucaacaccaacaagagcuuccacagcgugcacagaaacaccaucggcgacugccccaaguacgugaacgugaagagccugaagcuggccaccggccugagaaacgugcccgccaucgccagcagaggccuguucggcgccaucgccggcuucaucgagggcggcuggcccggccugaucaacggcugguacggcuuccagcacagaaacgaggagggcaccggcaucgccgccgacaaggagagcacccagaaggccaucgaccagaucaccagcaaggugaacaacaucguggacagaaugaacaccaacuucgagagcgugcagcacgaguucagcgagaucgaggagagaaucaaccagcugagcaagcacguggacgacagcgugguggacaucuggagcuacaacgcccagcugcuggugcugcuggagaacgagaagacccuggaccugcacgacagcaacgugagaaaccugcacgagaaggugagaagaaugcugaaggacaacgccaaggacgagggcaacggcugcuucaccuucuaccacaagugcgacaacgagugcaucgagagagugagaaacggcaccuacgaccacaaggaguucgaggaggagagcaagaucaacagacaggagaucgagggcgugaagcuggacagcagcggcaacguguacagaauccugagcaucuacagcugcaucgccagcagccuggugcuggccgcccugaucaugggcuucauccugugggccugcagcaacggcagcugcagaugcaccaucugcaucuga

SEQ ID NO: 162860 - RNA, 1698 nt, Artificial Sequence
  derived and/or modified sequence opt4 from hemagglutinin__InfluenzaA__AGQ81211
augaagaagacccugcuguucgccgccaucuuccuguacgugaaggccgacgagaucugcaucggcuaccugagcaacaacagcaccgacaagguggacaccaucaucgagaacaacgugaccgugaccagcagcguggagcugguggagaccgagcacaccggcagcuucugcagcaucaacggcaagcagcccaucagccugggcgacugcagcuucgccggcuggauccugggcaaccccaugugcgacgaccugaucggcaagaccagcuggagcuacaucguggagaagcccaaccccgccaacggcaucugcuaccccggcacccuggagaacgaggaggagcugagacugaaguucagcggcgugcuggaguucagcaaguucgaggccuucaccagcaacggcuggggcgccgugaacagcggcgccggcgugaccgccgccugcaaguucggcagcagcaacagcuucuucagaaacaugguguggcugauccaccagagcggcaccuaccccgugaucaagagaaccuucaacaacaccaagggcagagacgugcugaucguguggggcauccaccaccccgccacccugaaggagcaccaggaccuguacaagaaggacagcagcuacguggccgugggcagcgagaccuacaacagaagauucauccccgagaucagcaccagacccaaggugaacggccaggccggcagaaugaccuucuacuggaccaucgugaagcccggcgagagcaucaccuucgagagcaacggcgccuuccuggcccccagauacgccuucgagaucgugagcgugggcaacggcaagcuguucagaagcgagcugaacaucgagagcugcagcaccaagugccagaccgagaucggcggcaucaacaccaacaagagcuuccacagcgugcacagaaacaccaucggcgacugccccaaguacgugaacgugaagagccugaagcuggccaccggccugagaaacgugcccgccaucgccagcagaggccuguucggcgccaucgccggcuucaucgagggcggcuggcccggccugaucaacggcugguacggcuuccagcacagaaacgaggagggcaccggcaucgccgccgacaaggagagcacccagaaggccaucgaccagaucaccagcaaggugaacaacaucguggacagaaugaacaccaacuucgagagcgugcagcacgaguucagcgagaucgaggagagaaucaaccagcugagcaagcacguggacgacagcgugguggacaucuggagcuacaacgcccagcugcuggugcugcuggagaacgagaagacccuggaccugcacgacuucaacgugagaaaccugcacgagaaggugagaagaaugcugaaggacaacgccaaggacgagggcaacggcugcuucaccuucuaccacaagugcgacaacgagugcaucgagagagugagaaacggcaccuacgaccacaaggaguucgaggaggagagcaagaucaacagacaggagaucgagggcgugaagcuggacagcagcggcaacguguacagaauccugagcaucuacagcugcaucgccagcagccuggugcuggccgcccugaucaugggcuucauccugugggccugcagcaacggcagcugcagaugcaccaucugcaucuga

SEQ ID NO: 162861 - RNA, 1698 nt, Artificial Sequence
  derived and/or modified sequence opt4 from hemagglutinin__InfluenzaA__AGQ81213
augaagaagacccugcuguucgccgccaucuuccuguacgugagagccgacgagaucugcaucggcuaccugagcaacaacagcaccgacaagguggacaccaucaucgagaacaacgugaccgugaccagcagcguggagcugguggagaccgagcacaccggcagcuucugcagcaucaacggcaagcagcccaucagccugggcgacugcagcuucgccggcuggauccugggcaaccccaugugcgacggccugaucggcaagaccagcuggagcuacaucguggagaagcccaaccccgccaacggcaucugcuaccccggcacccuggagaacgaggaggagcugagacugaaguucagcagagugcuggaguucagcaaguucgaggccuucaccagcaacggcuggggcgccgugaacagcggcgccggcgugaccgccgccugcaaguucggcagcagcaacagcuucuucagaaacaugguguggcugauccaccagagcggcaccuaccccgugaucaagagaaccuucaacaacaccaagggcagagacgugcuggugguguggggcauccaccaccccgccacccugaaggagcaccaggaccuguacaagaaggacagcagcuacguggccgugggcagcgagaccuacaacagaagauucauccccgagaucagcaccagacccaccgugaacggccaggccggcagaaugaccuucuacuggaccaucgugaagcccggcgagagcaucaccuucgagagcaacggcgccuuccuggcccccagauacgccuucgagaucgugagcgugggcaacggcaagcuguucagaagcgagcugaacaucgagagcugcagcaccaagugccagaccgagaucggcggcaucaacaccaacaagagcuuccacagcgugcacagaaacaccaucggcgacugccccaaguacgugaacgugaagagccugaagcuggccaccggccugagaaacgugcccgccaucgccagcagaggccuguucggcgccaucgccggcuucaucgagggcggcuggcccggccugaucaacggcugguacggcuuccagcacagaaacgaggagggcaccggcaucgccgccgacaaggagagcacccagaaggccaucgaccagaucaccagcaaggugaacaacaucguggacagaaugaacaccaacuucgagagcgugcagcacgaguucagcgagaucgaggagagaaucaaccagcugagcaagcacguggacgacagcgugguggacaucuggagcuacaacgcccagcugcuggugcugcuggagaacgagaagacccuggaccugcacgacagcaacgugagaaaccugcacgagaaggugagaagaaugcugaaggacaacgccaaggacgagggcaacggcugcuucaccuucuaccacaagugcgacaacgagugcaucgagagagugagaaacggcaccuacgaccacaaggaguucgaggaggagagcaagaucaacagacaggagaucgagggcgugaagcuggacagcagcggcaacguguacaagauccugagcaucuacagcugcaucgccagcagccuggugcuggccgcccugaucaugggcuucauccugugggccugcagcaacggcagcugcagaugcaccaucugcaucuga

SEQ ID NO: 162862 - RNA, 1698 nt, Artificial Sequence
  derived and/or modified sequence opt4 from hemagglutinin__InfluenzaA__AGQ81214
augaagaagacccugcuguucgccgccaucuuccuguacgugaaggccgacgagaucugcaucggcuaccugagcaacaacagcaccgacaagguggacaccaucaucgagaacaacgugaccgugaccagcagcguggagcugguggagaccgagcacaccggcagcuucugcagcaucaacggcaagcagcccaucagccugggcgacugcagcuucgccggcuggauccugggcaaccccaugugcgacgaccugaucggcaagaccagcuggagcuacaucguggagaagcccaaccccgccaacggcaucugcuaccccggcacccuggagaacgaggaggagcugagacugaaguucagcggcgugcuggaguucagcaaguucgaggccuucaccagcaacggcuggggcgccgugaacagcggcgccggcgugaccgccgccugcaaguucggcagcagcaacagcuucuucagaaacaugguguggcugauccaccagagcggcaccuaccccgugaucaagagaaccuucaacaacaccaagggcagagacgugcugaucguguggggcauccaccaccccgccacccugaaggagcaccaggaccuguacaagaaggacagcagcuacguggccgugggcagcgagaccuacaacagaagauucauccccgagaucagcaccagacccaaggugaacggccaggccggcagaaugaccuucuacuggaccaucgugaagcccggcgagagcaucaccuucgagagcaacggcgccuuccuggcccccagauacgccuucgagaucgugagcgugggcaacggcaagcuguucagaagcgagcugaacaucgagagcugcagcaccaagugccagaccgagaucggcggcaucaacaccaacaagagcuuccacagcgugcacagaaacaccaucggcgacugccccaaguacgugaacgugaagagccugaagcuggccaccggccugagaaacgugcccgccaucaccagcagaggccuguucggcgccaucgccggcuucaucgagggcggcuggcccggccugaucaacggcugguacggcuuccagcacagaaacgaggagggcaccggcaucgccgccgacaaggagagcacccagaaggccaucgaccagaucaccagcaaggugaacaacaucguggacagaaugaacaccaacuucgagagcgugcagcacgaguucagcgagaucgagggcagaaucaaccagcugagcaagcacguggacgacagcgugguggacaucuggagcuacaacgcccagcugcuggugcugcuggagaacgagaagacccuggaccugcacgacagcaacgugagaaaccugcacgagaaggugagaagaaugcugaaggacaacgccaaggacgagggcaacggcugcuucaccuucuaccacaagugcgacaacgagugcaucgagagagugagaaacggcaccuacgaccacaaggaguucgaggaggagagcaagaucaacagacaggagaucgagggcgugaagcuggacagcagcggcaacguguacaagauccugagcaucuacagcugcaucgccagcagccuggugcuggccgcccugaucaugggcuucauccugugggccugcagcaacggcagcugcagaugcaccaucugcaucuga

SEQ ID NO: 162863 - RNA, 1698 nt, Artificial Sequence
  derived and/or modified sequence opt4 from hemagglutinin__InfluenzaA__AGQ81215
augaagaagacccugcuguucgccgccaucuuccuguacgugaaggccgacgagaucugcaucggcuaccugagcaacaacagcaccgacaagguggacaccaucaucgagaacaacgugaccgugaccagcagcguggagcugguggagaccgagcacaccggcagcuucugcagcaucaacggcaagcagcccaucagccugggcgacugcagcuucgccggcuggauccugggcaaccccaugugcgacggccugaucggcaagaccagcuggagcuacaucguggagaagcccaaccccgccaacggcaucugcuaccccggcacccuggagaacgaggaggagcugagacugaaguucagcggcauccuggaguucagcaaguucgaggccuucaccagcaacggcuggggcgccgugaacagcggcgccggcgugaccgccgccugcaaguucggcagcagcaacagcuucuucagacacaugguguggcugauccaccagagcggcaccuaccccgugaucaagagaaccuucaacaacaccaagggcagagacgugcuggugguguggggcauccaccaccccgccacccugaaggagcagcaggaccuguacaagaaggacagcagcuacguggccgugggcagcgagaccuacaacagaagauucauccccgagaucagcaccagacccaaggugaacggccaggccggcagaaugaccuucuacuggaccaucgugaagcccggcgagagcaucaccuucgagagcaacggcgccuuccuggcccccagauacgccuucgagaucgugagcgugggcaacggcaagcuguucagaagcgagcugaacaucgagagcugcagcaccaagugccagaccgagaucggcggcaucaacaccaacaagagcuuccacagcgugcacagaaacaccaucggcgacugccccaaguacgugaacgugaagagccugaagcuggccaccggccugagaaacgugcccgccaucgccagcagaggccuguucggcgccaucgccggcuucaucgagggcggcuggcccggccugaucaacggcugguacggcuuccagcacagaaacgaggagggcaccggcaucgccgccgacaaggagagcacccagaaggccaucgaccagaucaccagcaaggugaacaacaucguggacagaaugaacaccaacuucgagagcgugcagcacgaguucagcgagaucgaggagagaaucaaccagcugagcaagcacguggacgacagcgugguggacaucuggagcuacaacgcccagcugcuggugcugcuggagaacgagaagacccuggaccugcacgacagcaacgugagaaaccugcacgagaaggugagaagaaugcugaaggacaacgccaaggacgagggcaacggcugcuucaccuucuaccacaagugcgacaacgagugcaucgagagagugagaaacggcaccuacgaccacaaggaguucgaggaggagagcaagaucaacagacaggagaucgagggcgugaagcuggacagcagcggcaacguguacaagauccugagcaucuacagcugcaucgccagcagccuggugcuggccgcccugaucaugggcuucauccugugggccugcagcaacggcagcugcagaugcaccaucugcaucuga

SEQ ID NO: 162864 - RNA, 1698 nt, Artificial Sequence
  derived and/or modified sequence opt4 from hemagglutinin__InfluenzaA__AGQ81216
augaagaagacccugcuguucgccgccaucuuccuguacgugaaggccgacgagaucugcaucggcuaccugagcaacaacagcaccgacaagguggacaccaucaucgagaacaacgugaccgugaccagcagcguggagcugguggagaccgagcacaccggcagcuucugcagcaucaacggcaagcagcccaucagccugggcgacugcagcuucgccggcuggauccugggcaaccccaugugcgacgaccugaucggcaagaccagcuggagcuacaucguggagaagcccaaccccgccaacggcaucugcuaccccggcacccuggagaacgaggaggagcugagacugaaguucagcggcgugcuggaguucagcaaguucgaggccuucaccagcaacggcuggggcgccgugaacagcggcgccggcgugaccgccgccugcaaguucggcagcagcaacagcuucuucagaaacaugguguggcugauccaccagagcggcaccuaccccgugaccaagagaaccuucaacaacaccaagggcagagacgugcuggugguguggggcauccaccaccccgccacccugaaggagcaccaggaccuguacaagaaggacagcagcuacguggccgugggcagcgagaccuacaacagaagauucacccccgagaucagcaccagacccaaggugaacggccaggccggcagaaugaccuucuacuggaccaucgugaagcccggcgagagcaucaccuucgagagcaacggcgccuuccuggcccccagauacgccuucgagaucgugagcgugggcaacggcaagcuguucagaagcgagcugaacaucgagagcugcagcaccaagugccagaccgagaucggcggcaucaacaccaacaagagcuuccacagcgugcacagaaacaccaucggcgacugccccaaguacgugaacgugaagagccugaagcuggccaccggccugagaaacgugcccgccaucgccagcaagggccuguucggcgccaucgccggcuucaucgagggcggcuggcccggccugaucaacggcugguacggcuuccagcacagaaacgaggagggcaccggcaucgccgccgacaaggagagcacccagaaggccaucgaccagaucaccagcaaggugaacaacaucguggacagaaugaacaccaacuucgagagcgugagacacgaguucagcgagaucgaggagagaaucaaccagcugagcaagcacguggacgacagcgugguggacaucuggagcuacaacgcccagcugcuggugcugcuggagaacgagaagacccuggaccugcacgacagcaacgugagaaaccugcacgagagagugagaagaaugcugaaggacaacgccaaggacgagggcaacggcugcuucaccuucuaccacaagugcgacaacgagugcaucgagagagugagaaacggcaccuacgaccacaaggaguucgaggaggagagcaagaucaacagacaggagaucgagggcgugaagcuggacagcagcggcaacguguacaagauccugagcaucuacagcugcaucgccagcagccuggugcuggccgcccugaucaugggcuucauccugugggccugcggcaacggcagcugcagaugcaccaucugcaucuga

SEQ ID NO: 162865 - RNA, 1698 nt, Artificial Sequence
  derived and/or modified sequence opt4 from hemagglutinin__InfluenzaA__AGQ81217
augaagaagacccugcuguucgccgccaucuuccuguacgccaaggccgacgagaucugcaucggcuaccugagcaacaacagcaccgacaagguggacaccaucaucgagaacaacgugaccgugaccagcagcguggagcugguggagaccgagcacaccggcagcuucugcagcaucaacggcaagcagcccaucagccugggcgacugcagcuucgccggcuggauccugggcaaccccaugugcgacgaccugaucggcaagaccagcuggagcuacaucguggagaagcccaaccccgccaacggcaucugcuaccccggcacccuggagaacgaggaggagcugagacugaaguucagcggcgugcuggaguucagcagauucgaggccuucaccagcaacggcuggggcgccgugaacagcggcgccggcgugaccgccgccugcaaguucggcagcagcaacagcuucuucagaaacaugguguggcugauccaccagagcggcaccuaccccgugaucaagagaaccuucaacaacaccaagggcagagacgugcuggugguguggggcauccaccaccccgccacccugaaggagcaccaggaccuguacaagaaggacagcagcuacguggccgugggcagcgagaccuacaacagaagauucauccccgagaucagcaccagacccaaggugaacggccaggccggcagaaugaccuucuacuggaccaucgugaagcccgaggagagcaucaccuucgagagcaacggcgccuuccuggcccccagauacgccuucgagaucgugagcgugggcaacggcaagcuguucagaagcgagcugaacaucgagagcugcagcaccaagugccagaccgagaucggcggcaucaacaccaacaagagcuuccacagcgugcacagaaacaccaucggcgacugccccaaguacgugaacgugaagagccugaagcuggccaccggccugagaaacgugcccgccaucgccagcagaggccuguucggcgccaucgccggcuucaucgagggcggcuggcccggccugaucaacggcugguacggcuuccagcacagaaacgaggagggcaccggcaucgccgccgacaaggagagcacccagaaggccaucgaccagaucaccagcaaggugaacaacaucguggacagaaugaacaccaacuucgagagcgugcagcacgaguucagcgagaucgaggagagaaucaaccagcugagcaagcacguggacgacagcgugguggacaucuggagcuacaacgcccagcugcuggugcugcuggagaacgagaagacccuggaccugcacgacagcaacgugagaaaccugcacgagaaggugagaagaaugcugaaggacaacgccaaggacgagggcaacggcugcuucaccuucuaccacaagugcgacaacgagugcaucgagagagugagaaacggcaccuacgaccacaaggaguucgaggaggagagcaagaucaacagacaggagaucgagggcgugaagcuggacagcagcggcaacguguacaagauccugagcaucuacagcugcaucgccagcagccugauccuggccgcccugaucaugggcuucauccugugggccugcagcaacggcagcugcagaugcaccaucugcaucuga

SEQ ID NO: 162866 - RNA, 1704 nt, Artificial Sequence
  derived and/or modified sequence opt4 from hemagglutinin__InfluenzaA__AGQ88499
auggagaagaucgugcugcuguucgccaccaucagccuggugaagagcgaccacaucugcaucggcuaccacgccaacaacagcaccgagcagguggacaccaucauggagaagaacgugaccgugacccacgcccaggacauccuggagaagacccacaacggcaagcugugcgaccugaacggcgugaagccccugauccugaaggacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaaggacagcuggaccgaccacgaggccagccugggcgugagcgccgccugccccuaccagggcaacagcagcuucuucagaaacgugguguggcugaucaagaaggacaacgccuaccccaccaucaagaagggcuacaacaacaccaaccaggaggaccugcuggugcuguggggcauccaccaccccaacaacgaggccgagcagaccagacuguaccagaaccccaccaccuacaucagcaucggcaccagcacccugaaccagagacuggugcccaagaucgccaccagaagcaagaucaacggccagagcggcagaaucgacuucuucuggaccauccugaagcccaacgacgccauccacuucgagagcaacggcaacuucaucgcccccgaguacgccuacaagaucgugaagaagggcgacagcaccaucaugaagagcgagguggaguacggcaacugcaacaccagaugccagacccccaucggcgccaucaacagcagcaugcccuuccacaacauccacccccugaccaucggcgagugccccaaguacgugaagagcaacaagcuggugcuggccaccggccugagaaacagcccccagagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuaccacgacagcaacgugagaaaccuguacgacaaggugagacugcagcugaaggacaacgccaaggagcugggcaacggcugcuucgaguucuaccacaagugcaacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggugcuggccaucaugauggccggccugagccuguggaugugcagcaacggcagccugcagugcagaaucugcaucuga

SEQ ID NO: 162867 - RNA, 1683 nt, Artificial Sequence; identical to SEQ ID NO: 162757
  derived and/or modified sequence opt4 from hemagglutinin__InfluenzaA__AGR33888

SEQ ID NO: 162868 - RNA, 1683 nt, Artificial Sequence; identical to SEQ ID NO: 162757
  derived and/or modified sequence opt4 from hemagglutinin__InfluenzaA__AGR33889

SEQ ID NO: 162869 - RNA, 1683 nt, Artificial Sequence
  derived and/or modified sequence opt4 from hemagglutinin__InfluenzaA__AGR33890
augaacacccagauccugguguucgcccugaucgccaucacccccaccaacagcgacaagaucugccugggccaccacgccgugagcaacggcaccaaggugaacacccugaccgagagaggcguggagguggugaacgccaccgagaccguggagagaaccagcauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgccaccagcgccugcagaagaagcggcagcagcuucuacgccgagaugaaguggcugcugagcaacaccgacaacgccgccuucccccccaugaccaagagcuacaagaacaccagaaaggcccccgcccugaucaucuggggcauccaccacagcgugagcaccgccgagcagaccaagcuguacggcagcggcaacaagcuggugaccgugagaagcagcaacuaccagcagagcuucgugcccagccccggcgccggcccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagaguggugggcaagugccccagauacgugaagcagaagagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucaaccagaugaccggcaagcugaacagacugaucgagaagaccaaccagcaguucgagcugaucgacaacgaguucaccgagguggagaagcagaucggcaacgugaucaacuggaccagagacagcaucaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 162870 - RNA, 1683 nt, Artificial Sequence
  derived and/or modified sequence opt4 from hemagglutinin__InfluenzaA__AGR33892
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccagcauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucaacaaggaggccaugggcuucaccuacagcggcaucagaaccaacggcgccaccagcgccugcagaagaagcggcagcagcuucuacgccgagaugaaguggcugcugagcaacaccgacaacgccgccuucccccccaugaccaagagcuacaagaacaccagaaaggcccccgcccugaucaucuggggcauccaccacagcggcagcaccgccgagcagaccaagcuguacggcagcggcaacaagauggugaccgugagaagcagcaacuaccagcagagcuucgugcccagccccggcgccggcccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagaguggugggcaagugccccagauacgugaagcagaagagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucaaccagaugaccggcaagcugaacagacugaucgagaagaccaaccagcaguucgagcugaucgacaacgaguucaccgagguggagaagcagaucggcaacgugaucaacuggaccagagacagcaucaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgccaugggccugguguucaucugcguggagaacggcaacaugagaugcaccaucugcaucuga

SEQ ID NO: 162871 - RNA, 1683 nt, Artificial Sequence; identical to SEQ ID NO: 162749
  derived and/or modified sequence opt4 from hemagglutinin__InfluenzaA__AGR33895

SEQ ID NO: 162872 - RNA, 1683 nt, Artificial Sequence; identical to SEQ ID NO: 162828
  derived and/or modified sequence opt4 from hemagglutinin__InfluenzaA__AGR33897

SEQ ID NO: 162873 - RNA, 1683 nt, Artificial Sequence
  derived and/or modified sequence opt4 from hemagglutinin__InfluenzaA__AGR33899
auggagaccgugagccugaucaccauccugcugguggccaccgugagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccagccugggccagccccugauccuggacaccugcaccaucgagggccugaucuacggcaaccccagcugcgaccugcugcuggagggcagagaguggagcuacaucguggagagacccagcgccgugaacggccugugcuaccccggcaacguggagaaccuggaggagcugagaagccuguucagcagcgccagaagcuaccagagaauccagaucuuccccgacaccaucuggaacgugagcuacaacggcaccagcaaggccugcagcggcagcuucuacagaagcaugagauggcugacccagaagaacagcaacuaccccauccaggacgcccaguacaccaacaaccagggcaagaacauccuguucauguggggcaucaaccacccccccaccgacaccacccagagagaccuguacaccagaaccgacaccaccaccagcguggccaccgaggagaucaacagaaucuucaagccccugaucggccccagaccccuggugaacggccugaugggcagaaucgacuacuacuggagcgugcugaagcccggccagacccugagaaucaagagcgacggcaaccugaucgcccccugguacggccacauccugagcggcgagagccacggcagaauccugaagaccgaccugaagaagggcagcugcaccgugcagugccagaccgagaagggcggccugaacaccacccugcccuuccagaacgugagcaaguacgccuucggcaacugcagcaaguacaucggcaucaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaagcaaguaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162874 - RNA, 1683 nt, Artificial Sequence
  derived and/or modified sequence opt4 from hemagglutinin__InfluenzaA__AGR33900
auggagaccgugagccugaucaccauccugcugguggccaccgugagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccagccugggccagccccugauccuggacaccugcaccaucgagggccugaucuacggcaaccccagcugcgaccugcugcuggagggcagagaguggagcuacaucguggagagacccagcgccgugaacggccugugcuaccccggcaacguggagaaccuggaggagcugagaagccuguucagcagcgccagaagcuaccagagaauccagaucuuccccgacaccaucuggaacgugagcuacaacggcaccagcaaggccugcagcggcagcuucuacagaagcaugagauggcugacccagaagaacagcgacuaccccauccaggacgcccaguacaccaacaaccagggcaagaacauccuguucauguggggcaucaaccacccccccaccgacaccacccagagagaccuguacaccagaaccgacaccaccaccagcguggccaccgaggagaucaacagaaucuucaagccccugaucggccccagaccccuggugaacggccugaugggcagaaucgacuacuacuggagcgugcugaagcccggccagacccugagaaucaagagcgacggcaaccugaucgcccccugguacggccacauccugagcggcgagagccacggcagaauccugaagaccgaccugaagaagggcagcugcaccgugcagugccagaccgagaagggcggccugaacaccacccugcccuuccagaacgugagcaaguacgccuucggcaacugcagcaaguacaucggcaucaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgaccuguaccacaagugcgacgaccagugcauggagaccaucagaaacggcaccuacaacagaagaaaguaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162875 - RNA, 1683 nt, Artificial Sequence
  derived and/or modified sequence opt4 from hemagglutinin__InfluenzaA__AGR33902
auggagaccgccagccugaucaccauccugcugguggccaccgugagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccagccugggccagccccugauccuggacaccugcaccaucgagggccugaucuacggcaaccccagcugcgaccugcugcuggagggcagagaguggagcuacaucguggagagacccagcgccgugaacggccugugcuaccccggcaacguggagaaccuggaggagcugagaagccuguucagcagcgccagaagcuaccagagaauccagaucuuccccgacaccaccuggaacgugagcuacaacggcaucagcaaggccugcagcggcagcuucuacagaagcaugagauggcugacccagaagaacagcaacuaccccauccaggacgcccaguacaccaacaaccagggcaagaacauccuguucauguggggcaucaaccacccccccaccgacaccacccagagagaccuguacaccagaaccgacaccaccaccagcguggccaccgaggagaucaacagaaucuucaagccccugaucggccccagaccccuggugaacggccugaugggcagaaucgacuacuacuggagcgugcugaagcccggccagacccugagaaucaagagcgacggcaaccugaucgcccccugguacggccacauccugagcggcgagagccacggcagaauccugaagaccgaccugaagagaggcagcugcaccgugcagugccagaccgagaagggcggccugaacaccacccugcccuuccagaacgugagcaaguacgccuucggcaacugcagcaaguacaucggcaucaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacaaccagugcauggagaccaucagaaacggcaccuacaacagaagaaaguaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 162876 - RNA, 1698 nt, Artificial Sequence; identical to SEQ ID NO: 158033
  derived and/or modified sequence opt4 from hemagglutinin__InfluenzaA__AGR49817

SEQ ID NO: 162877 - RNA, 1698 nt, Artificial Sequence
  derived and/or modified sequence opt4 from hemagglutinin__InfluenzaA__AGR49841
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccagagacaccaucaucuucgaggccaacggcaaccugaucgcccccagauacgccuucgcccugagcagaggcuucggcagcggcaucaucaacagcaacgcccccaugggcaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaucggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162878 - RNA, 1698 nt, Artificial Sequence; identical to SEQ ID NO: 158033
  derived and/or modified sequence opt4 from hemagglutinin__InfluenzaA__AGR49853

SEQ ID NO: 162879 - RNA, 1698 nt, Artificial Sequence
  derived and/or modified sequence opt4 from hemagglutinin__InfluenzaA__AGR49865
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacaaccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucgugaaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugaacagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacguguggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162880 - RNA, 1701 nt, Artificial Sequence; identical to SEQ ID NO: 155176
  derived and/or modified sequence opt4 from hemagglutinin__InfluenzaA__AGR49877

SEQ ID NO: 162881 - RNA, 1701 nt, Artificial Sequence; identical to SEQ ID NO: 154954
  derived and/or modified sequence opt4 from hemagglutinin__InfluenzaA__AGR49888

SEQ ID NO: 162882 - RNA, 1701 nt, Artificial Sequence
  derived and/or modified sequence opt4 from hemagglutinin__InfluenzaA__AGR49900
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaagugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162883 - RNA, 1701 nt, Artificial Sequence
  derived and/or modified sequence opt4 from hemagglutinin__InfluenzaA__AGR49912
augaagaccaucaucgcccugagcuacauccugugccuggugagcgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcaagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162884 - RNA, 1701 nt, Artificial Sequence
  derived and/or modified sequence opt4 from hemagglutinin__InfluenzaA__AGR49924
augaagaccaucaucgcccugagcuacauccugugccuggugagcgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcaagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccguggaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162885 - RNA, 1701 nt, Artificial Sequence
  derived and/or modified sequence opt4 from hemagglutinin__InfluenzaA__AGR49936
augaagaccaucaucgcccugagcuacauccugugccugaucagcgcccagaaguuccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccggcuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162886 - RNA, 1701 nt, Artificial Sequence; identical to SEQ ID NO: 160214
  derived and/or modified sequence opt4 from hemagglutinin__InfluenzaA__AGR49948

SEQ ID NO: 162887 - RNA, 1701 nt, Artificial Sequence; identical to SEQ ID NO: 155047
  derived and/or modified sequence opt4 from hemagglutinin__InfluenzaA__AGR49960

SEQ ID NO: 162888 - RNA, 1701 nt, Artificial Sequence
  derived and/or modified sequence opt4 from hemagglutinin__InfluenzaA__AGR49972
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggaccaucguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162889 - RNA, 1698 nt, Artificial Sequence; identical to SEQ ID NO: 159218
  derived and/or modified sequence opt4 from hemagglutinin__InfluenzaA__AGR49983

SEQ ID NO: 162890 - RNA, 1698 nt, Artificial Sequence; identical to SEQ ID NO: 159218
  derived and/or modified sequence opt4 from hemagglutinin__InfluenzaA__AGR49995

SEQ ID NO: 162891 - RNA, 1701 nt, Artificial Sequence; identical to SEQ ID NO: 155176
  derived and/or modified sequence opt4 from hemagglutinin__InfluenzaA__AGR50007

SEQ ID NO: 162892 - RNA, 1701 nt, Artificial Sequence; identical to SEQ ID NO: 155176
  derived and/or modified sequence opt4 from hemagglutinin__InfluenzaA__AGR50018

SEQ ID NO: 162893 - RNA, 1701 nt, Artificial Sequence; identical to SEQ ID NO: 155176
  derived and/or modified sequence opt4 from hemagglutinin__InfluenzaA__AGR50029

SEQ ID NO: 162894 - RNA, 1701 nt, Artificial Sequence
  derived and/or modified sequence opt4 from hemagglutinin__InfluenzaA__AGR50040
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaugggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162895 - RNA, 1701 nt, Artificial Sequence; identical to SEQ ID NO: 155176
  derived and/or modified sequence opt4 from hemagglutinin__InfluenzaA__AGR50052

SEQ ID NO: 162896 - RNA, 1701 nt, Artificial Sequence; identical to SEQ ID NO: 155176
  derived and/or modified sequence opt4 from hemagglutinin__InfluenzaA__AGR50063

SEQ ID NO: 162897 - RNA, 1701 nt, Artificial Sequence
  derived and/or modified sequence opt4 from hemagglutinin__InfluenzaA__AGR50074
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagaaaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162898 - RNA, 1701 nt, Artificial Sequence; identical to SEQ ID NO: 155176
  derived and/or modified sequence opt4 from hemagglutinin__InfluenzaA__AGR50085

SEQ ID NO: 162899 - RNA, 1701 nt, Artificial Sequence; identical to SEQ ID NO: 155176
  derived and/or modified sequence opt4 from hemagglutinin__InfluenzaA__AGR50096

SEQ ID NO: 162900 - RNA, 1701 nt, Artificial Sequence; identical to SEQ ID NO: 155176
  derived and/or modified sequence opt4 from hemagglutinin__InfluenzaA__AGR50107

SEQ ID NO: 162901 - RNA, 1701 nt, Artificial Sequence; identical to SEQ ID NO: 155369
  derived and/or modified sequence opt4 from hemagglutinin__InfluenzaA__AGR50118

SEQ ID NO: 162902 - RNA, 1701 nt, Artificial Sequence
  derived and/or modified sequence opt4 from hemagglutinin__InfluenzaA__AGR50129
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggccagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162903 - RNA, 1701 nt, Artificial Sequence; identical to SEQ ID NO: 155176
  derived and/or modified sequence opt4 from hemagglutinin__InfluenzaA__AGR50140

SEQ ID NO: 162904 - RNA, 1701 nt, Artificial Sequence; identical to SEQ ID NO: 155371
  derived and/or modified sequence opt4 from hemagglutinin__InfluenzaA__AGR50151

SEQ ID NO: 162905 - RNA, 1698 nt, Artificial Sequence; identical to SEQ ID NO: 159218
  derived and/or modified sequence opt4 from hemagglutinin__InfluenzaA__AGR50162

SEQ ID NO: 162906 - RNA, 1701 nt, Artificial Sequence; identical to SEQ ID NO: 155176
  derived and/or modified sequence opt4 from hemagglutinin__InfluenzaA__AGR50174

SEQ ID NO: 162907 - RNA, 1701 nt, Artificial Sequence; identical to SEQ ID NO: 155215
  derived and/or modified sequence opt4 from hemagglutinin__InfluenzaA__AGR50185

SEQ ID NO: 162908 - RNA, 1701 nt, Artificial Sequence; identical to SEQ ID NO: 155176
  derived and/or modified sequence opt4 from hemagglutinin__InfluenzaA__AGR50196

SEQ ID NO: 162909 - RNA, 1701 nt, Artificial Sequence
  derived and/or modified sequence opt4 from hemagglutinin__InfluenzaA__AGR50207
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaagagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162910 - RNA, 1701 nt, Artificial Sequence; identical to SEQ ID NO: 155176
  derived and/or modified sequence opt4 from hemagglutinin__InfluenzaA__AGR50218

SEQ ID NO: 162911 - RNA, 1701 nt, Artificial Sequence; identical to SEQ ID NO: 155176
  derived and/or modified sequence opt4 from hemagglutinin__InfluenzaA__AGR50229

SEQ ID NO: 162912 - RNA, 1701 nt, Artificial Sequence; identical to SEQ ID NO: 155371
  derived and/or modified sequence opt4 from hemagglutinin__InfluenzaA__AGR50240

SEQ ID NO: 162913 - RNA, 1701 nt, Artificial Sequence; identical to SEQ ID NO: 155229
  derived and/or modified sequence opt4 from hemagglutinin__InfluenzaA__AGR50251

SEQ ID NO: 162914 - RNA, 1701 nt, Artificial Sequence
  derived and/or modified sequence opt4 from hemagglutinin__InfluenzaA__AGR50262
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagaagacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162915 - RNA, 1701 nt, Artificial Sequence; identical to SEQ ID NO: 155176
  derived and/or modified sequence opt4 from hemagglutinin__InfluenzaA__AGR50273

SEQ ID NO: 162916 - RNA, 1701 nt, Artificial Sequence
  derived and/or modified sequence opt4 from hemagglutinin__InfluenzaA__AGR50284
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacagccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162917 - RNA, 1701 nt, Artificial Sequence; identical to SEQ ID NO: 155919
  derived and/or modified sequence opt4 from hemagglutinin__InfluenzaA__AGR50295

SEQ ID NO: 162918 - RNA, 1701 nt, Artificial Sequence; identical to SEQ ID NO: 155176
  derived and/or modified sequence opt4 from hemagglutinin__InfluenzaA__AGR50306

SEQ ID NO: 162919 - RNA, 1701 nt, Artificial Sequence; identical to SEQ ID NO: 155176
  derived and/or modified sequence opt4 from hemagglutinin__InfluenzaA__AGR50317

SEQ ID NO: 162920 - RNA, 1701 nt, Artificial Sequence; identical to SEQ ID NO: 162909
  derived and/or modified sequence opt4 from hemagglutinin__InfluenzaA__AGR50328

SEQ ID NO: 162921 - RNA, 1701 nt, Artificial Sequence
  derived and/or modified sequence opt4 from hemagglutinin__InfluenzaA__AGR50339
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagaccagcaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162922 - RNA, 1701 nt, Artificial Sequence
  derived and/or modified sequence opt4 from hemagglutinin__InfluenzaA__AGR50350
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggaucaugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162923 - RNA, 1698 nt, Artificial Sequence
  derived and/or modified sequence opt4 from hemagglutinin__InfluenzaA__AGR50361
augaaggugcagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccaugggcaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 162924 - RNA, 1701 nt, Artificial Sequence
  derived and/or modified sequence opt4 from hemagglutinin__InfluenzaA__AGT18718
augaaggugauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162925 - RNA, 1701 nt, Artificial Sequence
  derived and/or modified sequence opt4 from hemagglutinin__InfluenzaA__AGT18720
augaaggugauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaaggccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccaacaccaccgccgaccagcagagccuguaccagaacgccgacgccuacguguucgugggcaccagcagauacagcaagaaguucaagcccgagaucgccaucagacccaaggugagagaccaggagagaagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162926 - RNA, 1701 nt, Artificial Sequence
  derived and/or modified sequence opt4 from hemagglutinin__InfluenzaA__AGT18721
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcauccagagaagcgagaucugcaccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccagaacagcagaggccaccagcagagccuguaccagaacgccgacgccuacguguucgugggcaccagcagauacagcaagaaguucaagcccgagaucgccaucagacccaaggugaaggagcaggacggcagaauggacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162927 - RNA, 1701 nt, Artificial Sequence
  derived and/or modified sequence opt4 from hemagglutinin__InfluenzaA__AGT18722
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaagagcaacaacagaaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162928 - RNA, 1701 nt, Artificial Sequence
  derived and/or modified sequence opt4 from hemagglutinin__InfluenzaA__AGT18723
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaagaccaacaacagaaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccagaacaagaaggccgagcagcagacccccuaccagaacgccgacgccuacguguucgugggcaccagcagauacagcaagaaguucaagcccgagaucgccaucagacccaaggugagagaccaggagggcagaauggacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162929 - RNA, 1701 nt, Artificial Sequence
  derived and/or modified sequence opt4 from hemagglutinin__InfluenzaA__AGT18724
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggugccccugcaccugggcaagugcaacaucgccggcuggauccugggcaaccccgagugcgagagccugagcaccgccagcagcuggagcuacaucguggagaccagcaagaccaacaacagaaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagacccuguaccagaacgccgacgccuacguguucgugggcaccagcagauacagcaagaaguucaagcccgagaucgccaucagacccaaggugagagaccaggagggcagaaugaacuacuacagaacccugaucgagcccgagaacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162930 - RNA, 1701 nt, Artificial Sequence
  derived and/or modified sequence opt4 from hemagglutinin__InfluenzaA__AGT18725
augaaggugauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaacccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162931 - RNA, 1701 nt, Artificial Sequence
  derived and/or modified sequence opt4 from hemagglutinin__InfluenzaA__AGT18734
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaucaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162932 - RNA, 1701 nt, Artificial Sequence; identical to SEQ ID NO: 162643
  derived and/or modified sequence opt4 from hemagglutinin__InfluenzaA__AGT18735

SEQ ID NO: 162933 - RNA, 1701 nt, Artificial Sequence
  derived and/or modified sequence opt4 from hemagglutinin__InfluenzaA__AGT18748
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacgaggagaacugcacccugaucgacgcccugcugggcgacccccagugcgacgacuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcagaagaggcagcaacagcagcuucuucagcagacugaacuggcugacccaccugaacuucaaguaccccgcccugaacgugaccaugcccaacaacgagcaguucgacaagcuguacaucuggggcgugcaccaccccagcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162934 - RNA, 1701 nt, Artificial Sequence
  derived and/or modified sequence opt4 from hemagglutinin__InfluenzaA__AGT18749
augaagaccaucaucgcccugagcuacauccugugccugguguucgcccagaagcugcccgagaacgacaacagcaccgccacccugugccugggccaccacgccgugcccaacggcaccaucgugaagaccaucaccgacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucagaaucagaagcggcagaagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162935 - RNA, 1701 nt, Artificial Sequence
  derived and/or modified sequence opt4 from hemagglutinin__InfluenzaA__AGT18751
augaagaccgugaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcagaagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaagagcgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162936 - RNA, 1701 nt, Artificial Sequence
  derived and/or modified sequence opt4 from hemagglutinin__InfluenzaA__AGT18752
augaagaccaucaucgcccugagcuacaucaucugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcagaagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacagcagcgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162937 - RNA, 1701 nt, Artificial Sequence
  derived and/or modified sequence opt4 from hemagglutinin__InfluenzaA__AGT18753
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcagaagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaagagcgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162938 - RNA, 1701 nt, Artificial Sequence
  derived and/or modified sequence opt4 from hemagglutinin__InfluenzaA__AGT18754
augaagaccaucaucgcccugagcuacauccugugccugguguucgcccagaagcugcccgagaacgacaacagcaccgccacccugugccugggccaccacgccgugcccaacggcaccaucgugaagaccaucaccgacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaggcaaggccuacagcaacugcuaccccuacgacgugcccgacuacgccagccugagaagccugguggccaccagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcagaagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162939 - RNA, 1701 nt, Artificial Sequence
  derived and/or modified sequence opt4 from hemagglutinin__InfluenzaA__AGT18756
augaagaccaucaucgcccugagcuacgugcugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacgacuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcagaagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaagagcgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162940 - RNA, 1701 nt, Artificial Sequence
  derived and/or modified sequence opt4 from hemagglutinin__InfluenzaA__AGT18757
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacgacuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcagaagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162941 - RNA, 1701 nt, Artificial Sequence
  derived and/or modified sequence opt4 from hemagglutinin__InfluenzaA__AGT18758
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacgacuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcagaagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacagcagcgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacaccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccuggugugcguggcccugcugggcuucaucaugugggccugccagaagggcaacaucagaugcaacaucugcaucuga

SEQ ID NO: 162942 - RNA, 1701 nt, Artificial Sequence
  derived and/or modified sequence opt4 from hemagglutinin__InfluenzaA__AGT18759
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacgacuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcagaagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacagcagcgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccuggugugcguggcccugcugggcuucaucaugugggccugccagaagggcaacaucagaugcaacaucugcaucuga

SEQ ID NO: 162943 - RNA, 1701 nt, Artificial Sequence
  derived and/or modified sequence opt4 from hemagglutinin__InfluenzaA__AGT18760
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacgacuuccagaacaagaagugggaccuguucguggagagaaacaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcagaagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaagagcgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccuggugugcguggcccugcugggcuucaucaugugggccugccagaagggcaacaucagaugcaacaucugcaucuga

SEQ ID NO: 162944 - RNA, 1701 nt, Artificial Sequence
  derived and/or modified sequence opt4 from hemagglutinin__InfluenzaA__AGT18761
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacgacuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcagaagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacagcagcgaguuccugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccuggugugcguggcccugcugggcuucaucaugugggccugccagaagggcaacaucagaugcaacaucugcaucuga

SEQ ID NO: 162945 - RNA, 1701 nt, Artificial Sequence
  derived and/or modified sequence opt4 from hemagglutinin__InfluenzaA__AGT37102
auggaggccaagcugguggugcuguucugcgccuucaccacccugaaggccgacaucaucugcgugggcuaccacgccaacaacagcaccgacaccguggacaccaucauggagaagaacgugaccgugacccacagcgugaaccugcuggagaacagccacaacggcaagcugugcagccugaacggcaaggccccccugcagcugggcaacugcaacguggccggcuggauccugggcaaccccgagugcgaccugcugcugaccgccaacagcuggagcuacaucaucgagaccagcagcagcaagaacggcaccugcuaccccggcgaguucagcgacuacgaggagcugagagagcugcugagcaccgugagcagcuucgagagauucgagaucuuccccaaggccaccagcuggcccaaccacgagaccaccaagggcgccaccaucgccugcagccacagcggcgccagcagcuucuacagaaaccugcuguggaucgugaagaagggcaacagcuaccccaagaucagcaagagcuacaccaacaacagaggcaaggaggugcuggugaucuggggcgugcaccacccccccaccgacagcagccagcaggcccuguaccagaacacccacaccuacaucagcgugggcagcagcaaguacuaccagagauucacccccgugguggccgccagacccaagaucagagagcaggagggcagaaugaacuacuacuggacccugcuggagcagggcgacaccaucaccuucgaggccaccggcaaccugaucgcccccugguacgccuucgcccuggacaugggcagcagcagcggcaucauggugagcgacgcccccgugcacaacugcaccaccaagugccagaccccccacggcgcccugaagagcaaccugcccuuccagaacgugcaccccaucaccaucggcgagugccccaaguacgugaagagcacccagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaucgccaucgacggcaucagcaacaaggugaacagcaucaucgagaagaugaacgugcaguucaccagcgugggcaaggaguucaacgaccuggagaagagaaucgagaaccugaacaagaagguggacgacggcuuccuggacguguggaccuacaacgccgagcugcuggugcugcuggagaacgagagaacccuggacuuccacgacuucaacgugaagaaccuguacgagaaggugaagagccagcugagaaacaacgccaaggagaucggcaacggcugcuucgaguucuaccacaagugcgacaacgagugcauggagaacgugaagaacggcaccuacaacuaccccaaguacagcgaggagagcaagcugaacagagagaagaucgacggcgugaagcuggagagcaucggcgugcaccagauccuggccaucuacagcaccguggccagcagccuggugcugcuggugagccugggcgccaucagcuucuggaugugcagcaacggcagccugcagugcagaaucugcaucuga

SEQ ID NO: 162946 - RNA, 1701 nt, Artificial Sequence
  derived and/or modified sequence opt4 from hemagglutinin__InfluenzaA__AGU01877
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162947 - RNA, 1701 nt, Artificial Sequence
  derived and/or modified sequence opt4 from hemagglutinin__InfluenzaA__AGU01878
augaaggccauccugguggugaugcuguacacccuggccaccgccaacgccgacacccugugcaucggcuaccacgccaacaacagcaccgacaccguggacaccgugcuggagaagaacgugaccgugacccacagcgugaaccugcuggaggacaagcacgacggcaagcugugcaagcugagaggcguggccccccugcaccugggcaagugcaacaucgccggcuggauccugggcaaccccgagugcgagagccugagcaccgccagcagcuggagcuacaucguggagaccagcggcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaucagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 162948 - RNA, 1701 nt, Artificial Sequence
  derived and/or modified sequence opt4 from hemagglutinin__InfluenzaA__AGU01879
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacgagaagcugugcaagcugagaggcguggccccccugcaccugggcaagugcaacaucgccggcuggauccugggcaaccccgagugcgagagccugagcaccgccagcagcuggagcuacaucguggagaccagcggcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccaggccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162949 - RNA, 1701 nt, Artificial Sequence
  derived and/or modified sequence opt4 from hemagglutinin__InfluenzaA__AGU01881
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcgugaccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagauguuccccaagaccagcagcuggcccaaccacgacagcaacaagggcgugaccgccgccugcccccaggccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162950 - RNA, 1701 nt, Artificial Sequence
  derived and/or modified sequence opt4 from hemagglutinin__InfluenzaA__AGU01883
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcggcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaucagcuacaucaacaacaaggagaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 162951 - RNA, 1701 nt, Artificial Sequence; identical to SEQ ID NO: 162580
  derived and/or modified sequence opt4 from hemagglutinin__InfluenzaA__AGU01884

SEQ ID NO: 162952 - RNA, 1701 nt, Artificial Sequence
  derived and/or modified sequence opt4 from hemagglutinin__InfluenzaA__AGU01885
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacgagaagcugugcaagcugagaggcguggccccccugcaccugggcaagugcaacaucgccggcuggauccugggcaaccccgagugcgagagccugagcaccgccagcagcuggagcuacaucguggagaccagcggcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccaggccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162953 - RNA, 1701 nt, Artificial Sequence
  derived and/or modified sequence opt4 from hemagglutinin__InfluenzaA__AGU01887
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccguggagagaaacgccggcagcggcaucaucaucagcgacacccccgugcacaacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162954 - RNA, 1701 nt, Artificial Sequence
  derived and/or modified sequence opt4 from hemagglutinin__InfluenzaA__AGU01888
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcggcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccaggccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacaccagauucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162955 - RNA, 1701 nt, Artificial Sequence; identical to SEQ ID NO: 162946
  derived and/or modified sequence opt4 from hemagglutinin__InfluenzaA__AGU01889

SEQ ID NO: 162956 - RNA, 1701 nt, Artificial Sequence
  derived and/or modified sequence opt4 from hemagglutinin__InfluenzaA__AGU01890
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcggcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccaggccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162957 - RNA, 1701 nt, Artificial Sequence
  derived and/or modified sequence opt4 from hemagglutinin__InfluenzaA__AGU92645
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagacccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgagaccagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 162958 - RNA, 1701 nt, Artificial Sequence
  derived and/or modified sequence opt4 from hemagglutinin__InfluenzaA__AGU92667
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagacccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaccagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagagcccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 162959 - RNA, 1701 nt, Artificial Sequence
  derived and/or modified sequence opt4 from hemagglutinin__InfluenzaA__AGU92678
augaaggccauccugguggugcugcuguacaccuucgccaccgccaacgccgacacccugugcaucggccaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagacccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaccagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 162960 - RNA, 1701 nt, Artificial Sequence
  derived and/or modified sequence opt4 from hemagglutinin__InfluenzaA__AGU92711
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagcagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162961 - RNA, 1701 nt, Artificial Sequence
  derived and/or modified sequence opt4 from hemagglutinin__InfluenzaA__AGU92722
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcgacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162962 - RNA, 1701 nt, Artificial Sequence; identical to SEQ ID NO: 162961
  derived and/or modified sequence opt4 from hemagglutinin__InfluenzaA__AGU92733

SEQ ID NO: 162963 - RNA, 1701 nt, Artificial Sequence
  derived and/or modified sequence opt4 from hemagglutinin__InfluenzaA__AGU92744
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcgacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcgccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162964 - RNA, 1701 nt, Artificial Sequence
  derived and/or modified sequence opt4 from hemagglutinin__InfluenzaA__AGU92755
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaaggaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162965 - RNA, 1701 nt, Artificial Sequence
  derived and/or modified sequence opt4 from hemagglutinin__InfluenzaA__AGU92766
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagacccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgagagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaccagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 162966 - RNA, 1701 nt, Artificial Sequence
  derived and/or modified sequence opt4 from hemagglutinin__InfluenzaA__AGU92777
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagacccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgagagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagcaucuaccagaacgccgacaccuacguguucgugggcaccagcagauacagcaagaaguucaagcccgagaucgccaccagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 162967 - RNA, 1701 nt, Artificial Sequence
  derived and/or modified sequence opt4 from hemagglutinin__InfluenzaA__AGU92788
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagacccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcgacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaccagacccaaggugagagacagagagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugcuggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 162968 - RNA, 1701 nt, Artificial Sequence
  derived and/or modified sequence opt4 from hemagglutinin__InfluenzaA__AGU92799
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagacccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaccagacccaaggugagagacagagagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 162969 - RNA, 1701 nt, Artificial Sequence
  derived and/or modified sequence opt4 from hemagglutinin__InfluenzaA__AGU92821
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagacccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagauguucaagcccgagaucgccaccagacccaaggugagagacagagagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 162970 - RNA, 1701 nt, Artificial Sequence
  derived and/or modified sequence opt4 from hemagglutinin__InfluenzaA__AGU92843
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcgacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162971 - RNA, 1710 nt, Artificial Sequence
  derived and/or modified sequence opt4 from hemagglutinin__InfluenzaA__AGU92854
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcgacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162972 - RNA, 1701 nt, Artificial Sequence
  derived and/or modified sequence opt4 from hemagglutinin__InfluenzaA__AGU92887
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgacgaccagcagagccuguaccagaacgccgacgccuacguguucgugggcagcagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162973 - RNA, 1701 nt, Artificial Sequence; identical to SEQ ID NO: 162957
  derived and/or modified sequence opt4 from hemagglutinin__InfluenzaA__AGU92898

SEQ ID NO: 162974 - RNA, 1701 nt, Artificial Sequence; identical to SEQ ID NO: 162958
  derived and/or modified sequence opt4 from hemagglutinin__InfluenzaA__AGU92909

SEQ ID NO: 162975 - RNA, 1701 nt, Artificial Sequence; identical to SEQ ID NO: 162960
  derived and/or modified sequence opt4 from hemagglutinin__InfluenzaA__AGU92931

SEQ ID NO: 162976 - RNA, 1701 nt, Artificial Sequence; identical to SEQ ID NO: 162961
  derived and/or modified sequence opt4 from hemagglutinin__InfluenzaA__AGU92942

SEQ ID NO: 162977 - RNA, 1701 nt, Artificial Sequence; identical to SEQ ID NO: 162961
  derived and/or modified sequence opt4 from hemagglutinin__InfluenzaA__AGU92953

SEQ ID NO: 162978 - RNA, 1701 nt, Artificial Sequence
  derived and/or modified sequence opt4 from hemagglutinin__InfluenzaA__AGU92964
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagacccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaccagacccaaggugagagacagagagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugcuggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 162979 - RNA, 1701 nt, Artificial Sequence
  derived and/or modified sequence opt4 from hemagglutinin__InfluenzaA__AGU92975
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagacccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaaggagaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaccagacccaaggugagagacagagagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 162980 - RNA, 1701 nt, Artificial Sequence; identical to SEQ ID NO: 162970
  derived and/or modified sequence opt4 from hemagglutinin__InfluenzaA__AGU92986

SEQ ID NO: 162981 - RNA, 1701 nt, Artificial Sequence
  derived and/or modified sequence opt4 from hemagglutinin__InfluenzaA__AGU92997
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagauguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 162982 - RNA, 1701 nt, Artificial Sequence; identical to SEQ ID NO: 162972
  derived and/or modified sequence opt4 from hemagglutinin__InfluenzaA__AGU93008

SEQ ID NO: 162983 - RNA, 1698 nt, Artificial Sequence; identical to SEQ ID NO: 159074
  derived and/or modified sequence opt4 from hemagglutinin__InfluenzaA__AGU93019

SEQ ID NO: 162984 - RNA, 1701 nt, Artificial Sequence; identical to SEQ ID NO: 159570
  derived and/or modified sequence opt4 from hemagglutinin__InfluenzaA__AGU93031

SEQ ID NO: 162985 - RNA, 1701 nt, Artificial Sequence
  derived and/or modified sequence opt4 from hemagglutinin__InfluenzaA__AGU93042
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagacccugagcaccgccaacagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacauccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 162986 - RNA, 1701 nt, Artificial Sequence
  derived and/or modified sequence opt4 from hemagglutinin__InfluenzaA__AGU93053
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagacccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaccagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 162987 - RNA, 1701 nt, Artificial Sequence
  derived and/or modified sequence opt4 from hemagglutinin__InfluenzaA__AGV99014
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162988 - RNA, 1701 nt, Artificial Sequence; identical to SEQ ID NO: 162514
  derived and/or modified sequence opt4 from hemagglutinin__InfluenzaA__AGV99037

SEQ ID NO: 162989 - RNA, 1701 nt, Artificial Sequence
  derived and/or modified sequence opt4 from hemagglutinin__InfluenzaA__AGV99049
augaagaccaucaucgcccugagcuacauccugugccugguguucgcccagaagcugcccggcaacgacaacagcaccgccacccugugccugggccaccacgccgugcccaacggcaccguggugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacggcaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 162990 - RNA, 1701 nt, Artificial Sequence
  derived and/or modified sequence opt4 from hemagglutinin__InfluenzaA__AGV99073
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagcccggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162991 - RNA, 1701 nt, Artificial Sequence; identical to SEQ ID NO: 162378
  derived and/or modified sequence opt4 from hemagglutinin__InfluenzaA__AGV99085

SEQ ID NO: 162992 - RNA, 1701 nt, Artificial Sequence
  derived and/or modified sequence opt4 from hemagglutinin__InfluenzaA__AGV99097
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagauccugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162993 - RNA, 1701 nt, Artificial Sequence
  derived and/or modified sequence opt4 from hemagglutinin__InfluenzaA__AGV99121
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacgacuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162994 - RNA, 1701 nt, Artificial Sequence; identical to SEQ ID NO: 162993
  derived and/or modified sequence opt4 from hemagglutinin__InfluenzaA__AGV99133

SEQ ID NO: 162995 - RNA, 1701 nt, Artificial Sequence; identical to SEQ ID NO: 162987
  derived and/or modified sequence opt4 from hemagglutinin__InfluenzaA__AGV99145

SEQ ID NO: 162996 - RNA, 1701 nt, Artificial Sequence
  derived and/or modified sequence opt4 from hemagglutinin__InfluenzaA__AGV99157
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucaucgagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacacccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 162997 - RNA, 1701 nt, Artificial Sequence; identical to SEQ ID NO: 162514
  derived and/or modified sequence opt4 from hemagglutinin__InfluenzaA__AGV99169

SEQ ID NO: 162998 - RNA, 1701 nt, Artificial Sequence; identical to SEQ ID NO: 162987
  derived and/or modified sequence opt4 from hemagglutinin__InfluenzaA__AGV99181

SEQ ID NO: 162999 - RNA, 1701 nt, Artificial Sequence
  derived and/or modified sequence opt4 from hemagglutinin__InfluenzaA__AGV99193
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacacccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163000 - RNA, 1701 nt, Artificial Sequence; identical to SEQ ID NO: 162388
  derived and/or modified sequence opt4 from hemagglutinin__InfluenzaA__AGV99956

SEQ ID NO: 163001 - RNA, 1701 nt, Artificial Sequence
  derived and/or modified sequence opt4 from hemagglutinin__InfluenzaA__AGV99986
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaucagaagaagcaacaacagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163002 - RNA, 1701 nt, Artificial Sequence
  derived and/or modified sequence opt4 from hemagglutinin__InfluenzaA__AGW00065
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacaccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163003 - RNA, 1701 nt, Artificial Sequence; identical to SEQ ID NO: 162514
  derived and/or modified sequence opt4 from hemagglutinin__InfluenzaA__AGW00077

SEQ ID NO: 163004 - RNA, 1701 nt, Artificial Sequence; identical to SEQ ID NO: 162378
  derived and/or modified sequence opt4 from hemagglutinin__InfluenzaA__AGW00089

SEQ ID NO: 163005 - RNA, 1701 nt, Artificial Sequence; identical to SEQ ID NO: 162514
  derived and/or modified sequence opt4 from hemagglutinin__InfluenzaA__AGW00101

SEQ ID NO: 163006 - RNA, 1701 nt, Artificial Sequence
  derived and/or modified sequence opt4 from hemagglutinin__InfluenzaA__AGW00113
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaccuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163007 - RNA, 1701 nt, Artificial Sequence; identical to SEQ ID NO: 162514
  derived and/or modified sequence opt4 from hemagglutinin__InfluenzaA__AGW00125

SEQ ID NO: 163008 - RNA, 1701 nt, Artificial Sequence; identical to SEQ ID NO: 162514
  derived and/or modified sequence opt4 from hemagglutinin__InfluenzaA__AGW00137

SEQ ID NO: 163009 - RNA, 1701 nt, Artificial Sequence; identical to SEQ ID NO: 162514
  derived and/or modified sequence opt4 from hemagglutinin__InfluenzaA__AGW00149

SEQ ID NO: 163010 - RNA, 1701 nt, Artificial Sequence; identical to SEQ ID NO: 162514
  derived and/or modified sequence opt4 from hemagglutinin__InfluenzaA__AGW00161

SEQ ID NO: 163011 - RNA, 1701 nt, Artificial Sequence; identical to SEQ ID NO: 162514
  derived and/or modified sequence opt4 from hemagglutinin__InfluenzaA__AGW00173

SEQ ID NO: 163012 - RNA, 1701 nt, Artificial Sequence
  derived and/or modified sequence opt4 from hemagglutinin__InfluenzaA__AGW00185
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucaucgagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163013 - RNA, 1701 nt, Artificial Sequence; identical to SEQ ID NO: 162514
  derived and/or modified sequence opt4 from hemagglutinin__InfluenzaA__AGW00709

SEQ ID NO: 163014 - RNA, 1701 nt, Artificial Sequence; identical to SEQ ID NO: 162514
  derived and/or modified sequence opt4 from hemagglutinin__InfluenzaA__AGW00721

SEQ ID NO: 163015 - RNA, 1701 nt, Artificial Sequence; identical to SEQ ID NO: 162514
  derived and/or modified sequence opt4 from hemagglutinin__InfluenzaA__AGW00733

SEQ ID NO: 163016 - RNA, 1701 nt, Artificial Sequence; identical to SEQ ID NO: 162514
  derived and/or modified sequence opt4 from hemagglutinin__InfluenzaA__AGW00745

SEQ ID NO: 163017 - RNA, 1701 nt, Artificial Sequence
  derived and/or modified sequence opt4 from hemagglutinin__InfluenzaA__AGW00757
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaaccugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163018 - RNA, 1701 nt, Artificial Sequence; identical to SEQ ID NO: 162517
  derived and/or modified sequence opt4 from hemagglutinin__InfluenzaA__AGW00769

SEQ ID NO: 163019 - RNA, 1701 nt, Artificial Sequence; identical to SEQ ID NO: 162403
  derived and/or modified sequence opt4 from hemagglutinin__InfluenzaA__AGW00781

SEQ ID NO: 163020 - RNA, 1701 nt, Artificial Sequence; identical to SEQ ID NO: 163002
  derived and/or modified sequence opt4 from hemagglutinin__InfluenzaA__AGW00793

SEQ ID NO: 163021 - RNA, 1701 nt, Artificial Sequence; identical to SEQ ID NO: 162514
  derived and/or modified sequence opt4 from hemagglutinin__InfluenzaA__AGW00805

SEQ ID NO: 163022 - RNA, 1701 nt, Artificial Sequence; identical to SEQ ID NO: 162355
  derived and/or modified sequence opt4 from hemagglutinin__InfluenzaA__AGW00817

SEQ ID NO: 163023 - RNA, 1701 nt, Artificial Sequence; identical to SEQ ID NO: 163001
  derived and/or modified sequence opt4 from hemagglutinin__InfluenzaA__AGW00829

SEQ ID NO: 163024 - RNA, 1701 nt, Artificial Sequence
  derived and/or modified sequence opt4 from hemagglutinin__InfluenzaA__AGW00841
augaagaccaucaucgcccugagcuacauccugugccugguguucgcccagaagcugcccggcaacgacaacagcaccgccacccugugccugggccaccacgccgugcccaacggcaccaucgugaagaccaucaccaacggcagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163025 - RNA, 1701 nt, Artificial Sequence
  derived and/or modified sequence opt4 from hemagglutinin__InfluenzaA__AGW00853
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagcccagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163026 - RNA, 1701 nt, Artificial Sequence; identical to SEQ ID NO: 162378
  derived and/or modified sequence opt4 from hemagglutinin__InfluenzaA__AGW00865

SEQ ID NO: 163027 - RNA, 1701 nt, Artificial Sequence
  derived and/or modified sequence opt4 from hemagglutinin__InfluenzaA__AGW00877
augaagaccaucaucgcccugagcuacauccugugccugguguucgcccaggagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcuucagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163028 - RNA, 1701 nt, Artificial Sequence
  derived and/or modified sequence opt4 from hemagglutinin__InfluenzaA__AGW00889
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacugggugcuguggaucagcuucgccaucagcugcuuccugcugugcguggcccugcugggcuucaucaugugggccugccagaagggcaacaucagaugcaacaucugcaucuga

SEQ ID NO: 163029 - RNA, 1701 nt, Artificial Sequence; identical to SEQ ID NO: 162378
  derived and/or modified sequence opt4 from hemagglutinin__InfluenzaA__AGW00901

SEQ ID NO: 163030 - RNA, 1701 nt, Artificial Sequence; identical to SEQ ID NO: 162378
  derived and/or modified sequence opt4 from hemagglutinin__InfluenzaA__AGW00913

SEQ ID NO: 163031 - RNA, 1701 nt, Artificial Sequence; identical to SEQ ID NO: 162514
  derived and/or modified sequence opt4 from hemagglutinin__InfluenzaA__AGW00931

SEQ ID NO: 163032 - RNA, 1701 nt, Artificial Sequence; identical to SEQ ID NO: 162514
  derived and/or modified sequence opt4 from hemagglutinin__InfluenzaA__AGW01244

SEQ ID NO: 163033 - RNA, 1701 nt, Artificial Sequence; identical to SEQ ID NO: 162388
  derived and/or modified sequence opt4 from hemagglutinin__InfluenzaA__AGW01256

SEQ ID NO: 163034 - RNA, 1701 nt, Artificial Sequence
  derived and/or modified sequence opt4 from hemagglutinin__InfluenzaA__AGW01295
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagauccugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163035 - RNA, 1701 nt, Artificial Sequence; identical to SEQ ID NO: 162378
  derived and/or modified sequence opt4 from hemagglutinin__InfluenzaA__AGW01307

SEQ ID NO: 163036 - RNA, 1701 nt, Artificial Sequence
  derived and/or modified sequence opt4 from hemagglutinin__InfluenzaA__AGW01319
augaagaccaucaucgcccugagcuacauccugugccugguguucgcccaggagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccaggacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacaagcugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163037 - RNA, 1701 nt, Artificial Sequence
  derived and/or modified sequence opt4 from hemagglutinin__InfluenzaA__AGW01331
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgagcacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163038 - RNA, 1701 nt, Artificial Sequence; identical to SEQ ID NO: 162514
  derived and/or modified sequence opt4 from hemagglutinin__InfluenzaA__AGW01343

SEQ ID NO: 163039 - RNA, 1701 nt, Artificial Sequence; identical to SEQ ID NO: 162517
  derived and/or modified sequence opt4 from hemagglutinin__InfluenzaA__AGW01355

SEQ ID NO: 163040 - RNA, 1701 nt, Artificial Sequence; identical to SEQ ID NO: 162388
  derived and/or modified sequence opt4 from hemagglutinin__InfluenzaA__AGW01367

SEQ ID NO: 163041 - RNA, 1701 nt, Artificial Sequence; identical to SEQ ID NO: 162514
  derived and/or modified sequence opt4 from hemagglutinin__InfluenzaA__AGW01391

SEQ ID NO: 163042 - RNA, 1701 nt, Artificial Sequence
  derived and/or modified sequence opt4 from hemagglutinin__InfluenzaA__AGW01403
augaagaccaucaucgcccugagcuacauccugugccugaucuucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacuacguguacagagacgaggcccugaacaacagauuccagaucaagggcguggagcugaagagcggcuacaaggacuggauccuguggaucagcuucgccaccagcugcuuccugcugugcguggcccugcugggcuucaucaugugggccugccagaagggcaacaucagaugcaacaucugcaucuga

SEQ ID NO: 163043 - RNA, 1701 nt, Artificial Sequence; identical to SEQ ID NO: 162378
  derived and/or modified sequence opt4 from hemagglutinin__InfluenzaA__AGW01415

SEQ ID NO: 163044 - RNA, 1701 nt, Artificial Sequence; identical to SEQ ID NO: 162378
  derived and/or modified sequence opt4 from hemagglutinin__InfluenzaA__AGW01427

SEQ ID NO: 163045 - RNA, 1701 nt, Artificial Sequence; identical to SEQ ID NO: 162378
  derived and/or modified sequence opt4 from hemagglutinin__InfluenzaA__AGW01439

SEQ ID NO: 163046 - RNA, 1701 nt, Artificial Sequence
  derived and/or modified sequence opt4 from hemagglutinin__InfluenzaA__AGW01451
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacgugguggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163047 - RNA, 1701 nt, Artificial Sequence; identical to SEQ ID NO: 162514
  derived and/or modified sequence opt4 from hemagglutinin__InfluenzaA__AGW01463

SEQ ID NO: 163048 - RNA, 1701 nt, Artificial Sequence; identical to SEQ ID NO: 162514
  derived and/or modified sequence opt4 from hemagglutinin__InfluenzaA__AGW01475

SEQ ID NO: 163049 - RNA, 1701 nt, Artificial Sequence
  derived and/or modified sequence opt4 from hemagglutinin__InfluenzaA__AGW01487
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaacuucaaguaccccgcccugaacgugaccaugcccaacaacgagcaguucgacaagcuguacaucuggggcgugcaccaccccggcaccggcaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163050 - RNA, 1701 nt, Artificial Sequence; identical to SEQ ID NO: 162378
  derived and/or modified sequence opt4 from hemagglutinin__InfluenzaA__AGW01499

SEQ ID NO: 163051 - RNA, 1701 nt, Artificial Sequence
  derived and/or modified sequence opt4 from hemagglutinin__InfluenzaA__AGW01511
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcgccgcccugcugggcuucaucaugugggccugccagaagggcaacaucagaugcaacaucugcaucuga

SEQ ID NO: 163052 - RNA, 1701 nt, Artificial Sequence
  derived and/or modified sequence opt4 from hemagglutinin__InfluenzaA__AGW01535
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaaggagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163053 - RNA, 1701 nt, Artificial Sequence; identical to SEQ ID NO: 162378
  derived and/or modified sequence opt4 from hemagglutinin__InfluenzaA__AGW01547

SEQ ID NO: 163054 - RNA, 1701 nt, Artificial Sequence; identical to SEQ ID NO: 162514
  derived and/or modified sequence opt4 from hemagglutinin__InfluenzaA__AGW01559

SEQ ID NO: 163055 - RNA, 1701 nt, Artificial Sequence; identical to SEQ ID NO: 162514
  derived and/or modified sequence opt4 from hemagglutinin__InfluenzaA__AGW01571

SEQ ID NO: 163056 - RNA, 1701 nt, Artificial Sequence; identical to SEQ ID NO: 162514
  derived and/or modified sequence opt4 from hemagglutinin__InfluenzaA__AGW01583

SEQ ID NO: 163057 - RNA, 1701 nt, Artificial Sequence; identical to SEQ ID NO: 162514
  derived and/or modified sequence opt4 from hemagglutinin__InfluenzaA__AGW01595

SEQ ID NO: 163058 - RNA, 1701 nt, Artificial Sequence
  derived and/or modified sequence opt4 from hemagglutinin__InfluenzaA__AGW01607
augaagaccaucaucgcccugagcuacauccugugccuggugcuggcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163059 - RNA, 1701 nt, Artificial Sequence; identical to SEQ ID NO: 162517
  derived and/or modified sequence opt4 from hemagglutinin__InfluenzaA__AGW01619

SEQ ID NO: 163060 - RNA, 1701 nt, Artificial Sequence; identical to SEQ ID NO: 162514
  derived and/or modified sequence opt4 from hemagglutinin__InfluenzaA__AGW01631

SEQ ID NO: 163061 - RNA, 1701 nt, Artificial Sequence
  derived and/or modified sequence opt4 from hemagglutinin__InfluenzaA__AGW01643
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163062 - RNA, 1701 nt, Artificial Sequence; identical to SEQ ID NO: 162514
  derived and/or modified sequence opt4 from hemagglutinin__InfluenzaA__AGW01655

SEQ ID NO: 163063 - RNA, 1701 nt, Artificial Sequence
  derived and/or modified sequence opt4 from hemagglutinin__InfluenzaA__AGW01667
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacgagaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163064 - RNA, 1701 nt, Artificial Sequence; identical to SEQ ID NO: 162514
  derived and/or modified sequence opt4 from hemagglutinin__InfluenzaA__AGW01679

SEQ ID NO: 163065 - RNA, 1701 nt, Artificial Sequence
  derived and/or modified sequence opt4 from hemagglutinin__InfluenzaA__AGW01691
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucgugaugugggccugccagaagggcaacaucagaugcaacaucugcaucuga

SEQ ID NO: 163066 - RNA, 1701 nt, Artificial Sequence; identical to SEQ ID NO: 162378
  derived and/or modified sequence opt4 from hemagglutinin__InfluenzaA__AGW01701

SEQ ID NO: 163067 - RNA, 1701 nt, Artificial Sequence; identical to SEQ ID NO: 162378
  derived and/or modified sequence opt4 from hemagglutinin__InfluenzaA__AGW01713

SEQ ID NO: 163068 - RNA, 1701 nt, Artificial Sequence
  derived and/or modified sequence opt4 from hemagglutinin__InfluenzaA__AGW01725
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugaucugcguggcccugcugggcuucaucaugugggccugccagaagggcaacaucagaugcaacaucugcaucuga

SEQ ID NO: 163069 - RNA, 1701 nt, Artificial Sequence; identical to SEQ ID NO: 162378
  derived and/or modified sequence opt4 from hemagglutinin__InfluenzaA__AGW01737

SEQ ID NO: 163070 - RNA, 1701 nt, Artificial Sequence; identical to SEQ ID NO: 162514
  derived and/or modified sequence opt4 from hemagglutinin__InfluenzaA__AGW01749

SEQ ID NO: 163071 - RNA, 1701 nt, Artificial Sequence; identical to SEQ ID NO: 162514
  derived and/or modified sequence opt4 from hemagglutinin__InfluenzaA__AGW01761

SEQ ID NO: 163072 - RNA, 1701 nt, Artificial Sequence; identical to SEQ ID NO: 162378
  derived and/or modified sequence opt4 from hemagglutinin__InfluenzaA__AGW01773

SEQ ID NO: 163073 - RNA, 1701 nt, Artificial Sequence; identical to SEQ ID NO: 162514
  derived and/or modified sequence opt4 from hemagglutinin__InfluenzaA__AGW01785

SEQ ID NO: 163074 - RNA, 1701 nt, Artificial Sequence; identical to SEQ ID NO: 162378
  derived and/or modified sequence opt4 from hemagglutinin__InfluenzaA__AGW01797

SEQ ID NO: 163075 - RNA, 1701 nt, Artificial Sequence; identical to SEQ ID NO: 162514
  derived and/or modified sequence opt4 from hemagglutinin__InfluenzaA__AGW01809

SEQ ID NO: 163076 - RNA, 1701 nt, Artificial Sequence; identical to SEQ ID NO: 162514
  derived and/or modified sequence opt4 from hemagglutinin__InfluenzaA__AGW01821

SEQ ID NO: 163077 - RNA, 1701 nt, Artificial Sequence; identical to SEQ ID NO: 162513
  derived and/or modified sequence opt4 from hemagglutinin__InfluenzaA__AGW01833

SEQ ID NO: 163078 - RNA, 1701 nt, Artificial Sequence
  derived and/or modified sequence opt4 from hemagglutinin__InfluenzaA__AGW01845
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaccaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163079 - RNA, 1701 nt, Artificial Sequence; identical to SEQ ID NO: 162514
  derived and/or modified sequence opt4 from hemagglutinin__InfluenzaA__AGW01857

SEQ ID NO: 163080 - RNA, 1701 nt, Artificial Sequence; identical to SEQ ID NO: 162514
  derived and/or modified sequence opt4 from hemagglutinin__InfluenzaA__AGW01869

SEQ ID NO: 163081 - RNA, 1701 nt, Artificial Sequence; identical to SEQ ID NO: 163065
  derived and/or modified sequence opt4 from hemagglutinin__InfluenzaA__AGW01881

SEQ ID NO: 163082 - RNA, 1701 nt, Artificial Sequence; identical to SEQ ID NO: 162388
  derived and/or modified sequence opt4 from hemagglutinin__InfluenzaA__AGW01893

SEQ ID NO: 163083 - RNA, 1701 nt, Artificial Sequence; identical to SEQ ID NO: 162403
  derived and/or modified sequence opt4 from hemagglutinin__InfluenzaA__AGW01905

SEQ ID NO: 163084 - RNA, 1701 nt, Artificial Sequence; identical to SEQ ID NO: 162514
  derived and/or modified sequence opt4 from hemagglutinin__InfluenzaA__AGW01917

SEQ ID NO: 163085 - RNA, 1701 nt, Artificial Sequence; identical to SEQ ID NO: 162378
  derived and/or modified sequence opt4 from hemagglutinin__InfluenzaA__AGW01929

SEQ ID NO: 163086 - RNA, 1701 nt, Artificial Sequence; identical to SEQ ID NO: 162514
  derived and/or modified sequence opt4 from hemagglutinin__InfluenzaA__AGW01941

SEQ ID NO: 163087 - RNA, 1701 nt, Artificial Sequence; identical to SEQ ID NO: 162378
  derived and/or modified sequence opt4 from hemagglutinin__InfluenzaA__AGW01953

SEQ ID NO: 163088 - RNA, 1701 nt, Artificial Sequence
  derived and/or modified sequence opt4 from hemagglutinin__InfluenzaA__AGW01965
augaagaccaucaucgcccugagcuacauccugugccugguguucgcccaggagcugcccggcaacgacgacagcauggccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgacugcaucggcagcaucagaaacggcaccuacgaccacaacguguacagagacgaggcccugaacaacagauuccagaucaagggcaucgagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163089 - RNA, 1701 nt, Artificial Sequence; identical to SEQ ID NO: 162514
  derived and/or modified sequence opt4 from hemagglutinin__InfluenzaA__AGW01977

SEQ ID NO: 163090 - RNA, 1701 nt, Artificial Sequence; identical to SEQ ID NO: 162514
  derived and/or modified sequence opt4 from hemagglutinin__InfluenzaA__AGW01989

SEQ ID NO: 163091 - RNA, 1701 nt, Artificial Sequence; identical to SEQ ID NO: 162514
  derived and/or modified sequence opt4 from hemagglutinin__InfluenzaA__AGW02001

SEQ ID NO: 163092 - RNA, 1701 nt, Artificial Sequence; identical to SEQ ID NO: 162514
  derived and/or modified sequence opt4 from hemagglutinin__InfluenzaA__AGW02013

SEQ ID NO: 163093 - RNA, 1701 nt, Artificial Sequence; identical to SEQ ID NO: 162378
  derived and/or modified sequence opt4 from hemagglutinin__InfluenzaA__AGW02025

SEQ ID NO: 163094 - RNA, 1701 nt, Artificial Sequence; identical to SEQ ID NO: 162514
  derived and/or modified sequence opt4 from hemagglutinin__InfluenzaA__AGW02037

SEQ ID NO: 163095 - RNA, 1701 nt, Artificial Sequence; identical to SEQ ID NO: 162514
  derived and/or modified sequence opt4 from hemagglutinin__InfluenzaA__AGW02061

SEQ ID NO: 163096 - RNA, 1701 nt, Artificial Sequence; identical to SEQ ID NO: 162514
  derived and/or modified sequence opt4 from hemagglutinin__InfluenzaA__AGW02073

SEQ ID NO: 163097 - RNA, 1701 nt, Artificial Sequence; identical to SEQ ID NO: 162514
  derived and/or modified sequence opt4 from hemagglutinin__InfluenzaA__AGW02085

SEQ ID NO: 163098 - RNA, 1701 nt, Artificial Sequence; identical to SEQ ID NO: 162403
  derived and/or modified sequence opt4 from hemagglutinin__InfluenzaA__AGW02097

SEQ ID NO: 163099 - RNA, 1701 nt, Artificial Sequence; identical to SEQ ID NO: 162378
  derived and/or modified sequence opt4 from hemagglutinin__InfluenzaA__AGW02109

SEQ ID NO: 163100 - RNA, 1701 nt, Artificial Sequence; identical to SEQ ID NO: 162514
  derived and/or modified sequence opt4 from hemagglutinin__InfluenzaA__AGW02133

SEQ ID NO: 163101 - RNA, 1701 nt, Artificial Sequence; identical to SEQ ID NO: 162514
  derived and/or modified sequence opt4 from hemagglutinin__InfluenzaA__AGW02157

SEQ ID NO: 163102 - RNA, 1701 nt, Artificial Sequence; identical to SEQ ID NO: 162378
  derived and/or modified sequence opt4 from hemagglutinin__InfluenzaA__AGW02169

SEQ ID NO: 163103 - RNA, 1701 nt, Artificial Sequence; identical to SEQ ID NO: 162514
  derived and/or modified sequence opt4 from hemagglutinin__InfluenzaA__AGW02181

SEQ ID NO: 163104 - RNA, 1701 nt, Artificial Sequence; identical to SEQ ID NO: 162388
  derived and/or modified sequence opt4 from hemagglutinin__InfluenzaA__AGW02193

SEQ ID NO: 163105 - RNA, 1701 nt, Artificial Sequence; identical to SEQ ID NO: 162355
  derived and/or modified sequence opt4 from hemagglutinin__InfluenzaA__AGW04171

SEQ ID NO: 163106 - RNA, 1707 nt, Artificial Sequence
  derived and/or modified sequence opt4 from hemagglutinin__InfluenzaA__AGW27061
auggagaagaucgugcugcuguucgccaucgugaaccuggugaagagcgaccacaucugcaucggcuaccacgccaacaacagcaccgagcagguggacaccaucauggagaagaacgugaccgugacccacgcccaggacauccuggagaagacccacaacggcaagcugugcgaccugaacggcgugaagccccugauccugaaggacugcagcguggccggcuggcugcugggcaaccccaugugcgacgaguucaucgacgugcccgaguggagcuacaucguggagaaggccaaccccgccaacgaccugugcuaccccggcaacuucaacgacuacgaggagcugaagcaccugcugagcagaaucaaccacuucgagaagaucagaaucauccccaaggacagcuggcccgaccacgaggccagccugggcgugagcgccgccugcagcuaccagggcaacagcagcuucuucagaaacgugguguggcugcugaagaagaacgacgccuaccccaucaucaagaagagcuacaacaacaccaacaaggaggaccugcuggugcuguggggcauccaccaccccaacgacgaggccgagcagaucagacuguaccagaaccccaccaccuacgugagcaccggcaccagcacccugaaccagagacuggugcccagaaucgccaccagaagcaaggugaacggccagagcggcagaaucgacuucuucuggaccauccugaagcccaacgacgccaucaacuucgagagcaacggcaacuucaucgcccccgaguacgccuacaagaucgugaagaagggcgacagcaccaucaugagaagcgagguggaguacggcaacugcagcaccagaugccagacccccaugggcgccaucaacagcagcaugcccuuccacaacauccacccccugaccaucggcgagugccccaaguacgugaagagcaacaagcuggugcuggccaccggccugagaaacagcccccagaucgagagaagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggugcugagcaucaugguggccggccugagccuguggaugugcagcaacggcagccugcagugcagaaugugcaucuga

SEQ ID NO: 163107 - RNA, 1698 nt, Artificial Sequence
  derived and/or modified sequence opt4 from hemagglutinin__InfluenzaA__AGY14471
augaaggugaagcugcugauccugcugugcaccuucaccgccaccuacgccgacaccaucugcaucggcuaccacgccaacaacagcaccgacaccguggacaccauccuggagaagaacgugaccgugacccacagcgugaaccugcuggaggacagccacaacggcaagcugugccugcugaagggcaucgccccccugcagcugggcaacugcagcguggccggcuggauccugggcaaccccgagugcggccugcugauccccaaggagagcuggagcuacaucguggagacccccaaccccgagaacggcaccugcuaccccggcuacuucgacgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcugauccuguggggcgugcaccaccccagcaacaucggcaaccagagaacccuguaccacaccgagaacaccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcaagggcuucggcagcggcaucaucaccagcaacgcccccauggacgagugcgacgccaagugccagaccccccagggcgccaucaacagcaaccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccaggagagcacccagaacgccaucaacggcaucaccaacaaggugaacagcgugaucgagaagaugaacacccaguucaccguggugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaugaaccuguacgagaaggugaagggccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 163108 - RNA, 1698 nt, Artificial Sequence; identical to SEQ ID NO: 163107
  derived and/or modified sequence opt4 from hemagglutinin__InfluenzaA__AGY14477

SEQ ID NO: 163109 - RNA, 1701 nt, Artificial Sequence
  derived and/or modified sequence opt4 from hemagglutinin__InfluenzaA__AHC57459
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagaaucagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163110 - RNA, 1701 nt, Artificial Sequence; identical to SEQ ID NO: 159502
  derived and/or modified sequence opt4 from hemagglutinin__InfluenzaA__AHC57465

SEQ ID NO: 163111 - RNA, 1701 nt, Artificial Sequence; identical to SEQ ID NO: 159375
  derived and/or modified sequence opt4 from hemagglutinin__InfluenzaA__AHC57487

SEQ ID NO: 163112 - RNA, 1701 nt, Artificial Sequence; identical to SEQ ID NO: 160302
  derived and/or modified sequence opt4 from hemagglutinin__InfluenzaA__AHC57499

SEQ ID NO: 163113 - RNA, 1701 nt, Artificial Sequence; identical to SEQ ID NO: 160302
  derived and/or modified sequence opt4 from hemagglutinin__InfluenzaA__AHC57511

SEQ ID NO: 163114 - RNA, 1701 nt, Artificial Sequence; identical to SEQ ID NO: 160302
  derived and/or modified sequence opt4 from hemagglutinin__InfluenzaA__AHC57523

SEQ ID NO: 163115 - RNA, 1701 nt, Artificial Sequence; identical to SEQ ID NO: 159502
  derived and/or modified sequence opt4 from hemagglutinin__InfluenzaA__AHC57675

SEQ ID NO: 163116 - RNA, 1701 nt, Artificial Sequence; identical to SEQ ID NO: 159502
  derived and/or modified sequence opt4 from hemagglutinin__InfluenzaA__AHC57827

SEQ ID NO: 163117 - RNA, 1701 nt, Artificial Sequence; identical to SEQ ID NO: 159375
  derived and/or modified sequence opt4 from hemagglutinin__InfluenzaA__AHC57956

SEQ ID NO: 163118 - RNA, 1701 nt, Artificial Sequence
  derived and/or modified sequence opt4 from hemagglutinin__InfluenzaA__AHC57981
augaagaccaucaucgcccugagcuacauccugugccugguguucgcccagaagauccccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaaccugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163119 - RNA, 1701 nt, Artificial Sequence; identical to SEQ ID NO: 160302
  derived and/or modified sequence opt4 from hemagglutinin__InfluenzaA__AHC57993

SEQ ID NO: 163120 - RNA, 1701 nt, Artificial Sequence; identical to SEQ ID NO: 161594
  derived and/or modified sequence opt4 from hemagglutinin__InfluenzaA__AHC58005

SEQ ID NO: 163121 - RNA, 1701 nt, Artificial Sequence
  derived and/or modified sequence opt4 from hemagglutinin__InfluenzaA__AHC58017
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucgugagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163122 - RNA, 1701 nt, Artificial Sequence
  derived and/or modified sequence opt4 from hemagglutinin__InfluenzaA__AHC58029
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcaacaacagcuucuucagcagacugaacuggcugacccagcugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163123 - RNA, 1701 nt, Artificial Sequence
  derived and/or modified sequence opt4 from hemagglutinin__InfluenzaA__AHC58050
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccagaagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163124 - RNA, 1701 nt, Artificial Sequence; identical to SEQ ID NO: 160302
  derived and/or modified sequence opt4 from hemagglutinin__InfluenzaA__AHC58074

SEQ ID NO: 163125 - RNA, 1701 nt, Artificial Sequence; identical to SEQ ID NO: 160302
  derived and/or modified sequence opt4 from hemagglutinin__InfluenzaA__AHC58098

SEQ ID NO: 163126 - RNA, 1701 nt, Artificial Sequence; identical to SEQ ID NO: 160302
  derived and/or modified sequence opt4 from hemagglutinin__InfluenzaA__AHC58110

SEQ ID NO: 163127 - RNA, 1701 nt, Artificial Sequence; identical to SEQ ID NO: 160302
  derived and/or modified sequence opt4 from hemagglutinin__InfluenzaA__AHC58126

SEQ ID NO: 163128 - RNA, 1701 nt, Artificial Sequence; identical to SEQ ID NO: 160302
  derived and/or modified sequence opt4 from hemagglutinin__InfluenzaA__AHC58138

SEQ ID NO: 163129 - RNA, 1701 nt, Artificial Sequence; identical to SEQ ID NO: 160302
  derived and/or modified sequence opt4 from hemagglutinin__InfluenzaA__AHC58162

SEQ ID NO: 163130 - RNA, 1701 nt, Artificial Sequence; identical to SEQ ID NO: 161594
  derived and/or modified sequence opt4 from hemagglutinin__InfluenzaA__AHC58186

SEQ ID NO: 163131 - RNA, 1701 nt, Artificial Sequence
  derived and/or modified sequence opt4 from hemagglutinin__InfluenzaA__AHC58198
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccagaaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggacugccagaagggcaacaucagaugcaacaucugcaucuga

SEQ ID NO: 163132 - RNA, 1701 nt, Artificial Sequence
  derived and/or modified sequence opt4 from hemagglutinin__InfluenzaA__AHC58210
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163133 - RNA, 1701 nt, Artificial Sequence; identical to SEQ ID NO: 159502
  derived and/or modified sequence opt4 from hemagglutinin__InfluenzaA__AHC58234

SEQ ID NO: 163134 - RNA, 1701 nt, Artificial Sequence; identical to SEQ ID NO: 160302
  derived and/or modified sequence opt4 from hemagglutinin__InfluenzaA__AHC58246

SEQ ID NO: 163135 - RNA, 1701 nt, Artificial Sequence; identical to SEQ ID NO: 159502
  derived and/or modified sequence opt4 from hemagglutinin__InfluenzaA__AHC58258

SEQ ID NO: 163136 - RNA, 1701 nt, Artificial Sequence; identical to SEQ ID NO: 159375
  derived and/or modified sequence opt4 from hemagglutinin__InfluenzaA__AHC58270

SEQ ID NO: 163137 - RNA, 1701 nt, Artificial Sequence
  derived and/or modified sequence opt4 from hemagglutinin__InfluenzaA__AHC58372
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugacccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163138 - RNA, 1701 nt, Artificial Sequence
  derived and/or modified sequence opt4 from hemagglutinin__InfluenzaA__AHC58396
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163139 - RNA, 1701 nt, Artificial Sequence; identical to SEQ ID NO: 160302
  derived and/or modified sequence opt4 from hemagglutinin__InfluenzaA__AHC58408

SEQ ID NO: 163140 - RNA, 1701 nt, Artificial Sequence; identical to SEQ ID NO: 161594
  derived and/or modified sequence opt4 from hemagglutinin__InfluenzaA__AHC58420

SEQ ID NO: 163141 - RNA, 1701 nt, Artificial Sequence; identical to SEQ ID NO: 161594
  derived and/or modified sequence opt4 from hemagglutinin__InfluenzaA__AHC58432

SEQ ID NO: 163142 - RNA, 1701 nt, Artificial Sequence; identical to SEQ ID NO: 159502
  derived and/or modified sequence opt4 from hemagglutinin__InfluenzaA__AHC58444

SEQ ID NO: 163143 - RNA, 1701 nt, Artificial Sequence; identical to SEQ ID NO: 163138
  derived and/or modified sequence opt4 from hemagglutinin__InfluenzaA__AHC58456

SEQ ID NO: 163144 - RNA, 1701 nt, Artificial Sequence
  derived and/or modified sequence opt4 from hemagglutinin__InfluenzaA__AHC58468
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccaggccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgcccagggcagcggcuacgccgccgaccugaagagcacccagaacgccaucgacaagaucaccaacaaggugaacagcgugaucgagaagaugaacacccaguucaccgccgugggcaaggaguucaaccaccuggagagaagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163145 - RNA, 1701 nt, Artificial Sequence
  derived and/or modified sequence opt4 from hemagglutinin__InfluenzaA__AHC58479
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagaucaucgacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauucaagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163146 - RNA, 1701 nt, Artificial Sequence; identical to SEQ ID NO: 163138
  derived and/or modified sequence opt4 from hemagglutinin__InfluenzaA__AHC58491

SEQ ID NO: 163147 - RNA, 1701 nt, Artificial Sequence; identical to SEQ ID NO: 159502
  derived and/or modified sequence opt4 from hemagglutinin__InfluenzaA__AHC58515

SEQ ID NO: 163148 - RNA, 1701 nt, Artificial Sequence; identical to SEQ ID NO: 160302
  derived and/or modified sequence opt4 from hemagglutinin__InfluenzaA__AHC58527

SEQ ID NO: 163149 - RNA, 1701 nt, Artificial Sequence
  derived and/or modified sequence opt4 from hemagglutinin__InfluenzaA__AHC58563
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagaucaucgacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163150 - RNA, 1701 nt, Artificial Sequence; identical to SEQ ID NO: 160302
  derived and/or modified sequence opt4 from hemagglutinin__InfluenzaA__AHC58575

SEQ ID NO: 163151 - RNA, 1701 nt, Artificial Sequence; identical to SEQ ID NO: 159375
  derived and/or modified sequence opt4 from hemagglutinin__InfluenzaA__AHC58587

SEQ ID NO: 163152 - RNA, 1701 nt, Artificial Sequence; identical to SEQ ID NO: 159502
  derived and/or modified sequence opt4 from hemagglutinin__InfluenzaA__AHC58599

SEQ ID NO: 163153 - RNA, 1701 nt, Artificial Sequence; identical to SEQ ID NO: 160302
  derived and/or modified sequence opt4 from hemagglutinin__InfluenzaA__AHC58611

SEQ ID NO: 163154 - RNA, 1701 nt, Artificial Sequence; identical to SEQ ID NO: 160302
  derived and/or modified sequence opt4 from hemagglutinin__InfluenzaA__AHC58623

SEQ ID NO: 163155 - RNA, 1701 nt, Artificial Sequence; identical to SEQ ID NO: 160302
  derived and/or modified sequence opt4 from hemagglutinin__InfluenzaA__AHC58647

SEQ ID NO: 163156 - RNA, 1701 nt, Artificial Sequence; identical to SEQ ID NO: 159502
  derived and/or modified sequence opt4 from hemagglutinin__InfluenzaA__AHC58659

SEQ ID NO: 163157 - RNA, 1701 nt, Artificial Sequence; identical to SEQ ID NO: 159375
  derived and/or modified sequence opt4 from hemagglutinin__InfluenzaA__AHC58671

SEQ ID NO: 163158 - RNA, 1701 nt, Artificial Sequence; identical to SEQ ID NO: 161594
  derived and/or modified sequence opt4 from hemagglutinin__InfluenzaA__AHC58683

SEQ ID NO: 163159 - RNA, 1701 nt, Artificial Sequence; identical to SEQ ID NO: 159375
  derived and/or modified sequence opt4 from hemagglutinin__InfluenzaA__AHC58695

SEQ ID NO: 163160 - RNA, 1701 nt, Artificial Sequence; identical to SEQ ID NO: 161594
  derived and/or modified sequence opt4 from hemagglutinin__InfluenzaA__AHC58707

SEQ ID NO: 163161 - RNA, 1701 nt, Artificial Sequence; identical to SEQ ID NO: 161594
  derived and/or modified sequence opt4 from hemagglutinin__InfluenzaA__AHC58719

SEQ ID NO: 163162 - RNA, 1701 nt, Artificial Sequence; identical to SEQ ID NO: 163138
  derived and/or modified sequence opt4 from hemagglutinin__InfluenzaA__AHC58731

SEQ ID NO: 163163 - RNA, 1701 nt, Artificial Sequence
  derived and/or modified sequence opt4 from hemagglutinin__InfluenzaA__AHC58743
augaagaccaucaucgccuggagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163164 - RNA, 1701 nt, Artificial Sequence; identical to SEQ ID NO: 163138
  derived and/or modified sequence opt4 from hemagglutinin__InfluenzaA__AHC58755

SEQ ID NO: 163165 - RNA, 1701 nt, Artificial Sequence; identical to SEQ ID NO: 159375
  derived and/or modified sequence opt4 from hemagglutinin__InfluenzaA__AHC58779

SEQ ID NO: 163166 - RNA, 1701 nt, Artificial Sequence; identical to SEQ ID NO: 163137
  derived and/or modified sequence opt4 from hemagglutinin__InfluenzaA__AHC58791

SEQ ID NO: 163167 - RNA, 1701 nt, Artificial Sequence
  derived and/or modified sequence opt4 from hemagglutinin__InfluenzaA__AHC58803
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagaucaucgacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugaagagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauucaagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163168 - RNA, 1701 nt, Artificial Sequence
  derived and/or modified sequence opt4 from hemagglutinin__InfluenzaA__AHC58815
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcggcaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163169 - RNA, 1701 nt, Artificial Sequence; identical to SEQ ID NO: 159375
  derived and/or modified sequence opt4 from hemagglutinin__InfluenzaA__AHC58827

SEQ ID NO: 163170 - RNA, 1701 nt, Artificial Sequence; identical to SEQ ID NO: 160302
  derived and/or modified sequence opt4 from hemagglutinin__InfluenzaA__AHC58839

SEQ ID NO: 163171 - RNA, 1701 nt, Artificial Sequence
  derived and/or modified sequence opt4 from hemagglutinin__InfluenzaA__AHC58863
augaagaccaucaucgcccugagcuacauccugugccugguguucgcccagaagcugcccggcaacgacaacagcaccgccacccugugccugggccaccacgccgugagcaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163172 - RNA, 1701 nt, Artificial Sequence; identical to SEQ ID NO: 159375
  derived and/or modified sequence opt4 from hemagglutinin__InfluenzaA__AHC58875

SEQ ID NO: 163173 - RNA, 1701 nt, Artificial Sequence; identical to SEQ ID NO: 160302
  derived and/or modified sequence opt4 from hemagglutinin__InfluenzaA__AHC58887

SEQ ID NO: 163174 - RNA, 1701 nt, Artificial Sequence; identical to SEQ ID NO: 163138
  derived and/or modified sequence opt4 from hemagglutinin__InfluenzaA__AHC58899

SEQ ID NO: 163175 - RNA, 1701 nt, Artificial Sequence; identical to SEQ ID NO: 160302
  derived and/or modified sequence opt4 from hemagglutinin__InfluenzaA__AHC58981

SEQ ID NO: 163176 - RNA, 1701 nt, Artificial Sequence; identical to SEQ ID NO: 160302
  derived and/or modified sequence opt4 from hemagglutinin__InfluenzaA__AHC58993

SEQ ID NO: 163177 - RNA, 1701 nt, Artificial Sequence; identical to SEQ ID NO: 160302
  derived and/or modified sequence opt4 from hemagglutinin__InfluenzaA__AHC59005

SEQ ID NO: 163178 - RNA, 1701 nt, Artificial Sequence
  derived and/or modified sequence opt4 from hemagglutinin__InfluenzaA__AHC59017
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugagcaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163179 - RNA, 1701 nt, Artificial Sequence; identical to SEQ ID NO: 163138
  derived and/or modified sequence opt4 from hemagglutinin__InfluenzaA__AHC59029

SEQ ID NO: 163180 - RNA, 1701 nt, Artificial Sequence; identical to SEQ ID NO: 159502
  derived and/or modified sequence opt4 from hemagglutinin__InfluenzaA__AHC59041

SEQ ID NO: 163181 - RNA, 1701 nt, Artificial Sequence
  derived and/or modified sequence opt4 from hemagglutinin__InfluenzaA__AHC59053
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucauguggaccugccagaagggcaacaucagaugcaacaucugcaucuga

SEQ ID NO: 163182 - RNA, 1701 nt, Artificial Sequence
  derived and/or modified sequence opt4 from hemagglutinin__InfluenzaA__AHC59077
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 163183 - RNA, 1701 nt, Artificial Sequence; identical to SEQ ID NO: 161594
  derived and/or modified sequence opt4 from hemagglutinin__InfluenzaA__AHC59089

SEQ ID NO: 163184 - RNA, 1701 nt, Artificial Sequence; identical to SEQ ID NO: 160302
  derived and/or modified sequence opt4 from hemagglutinin__InfluenzaA__AHC59101

SEQ ID NO: 163185 - RNA, 1701 nt, Artificial Sequence; identical to SEQ ID NO: 159502
  derived and/or modified sequence opt4 from hemagglutinin__InfluenzaA__AHC59113

SEQ ID NO: 163186 - RNA, 1701 nt, Artificial Sequence; identical to SEQ ID NO: 160302
  derived and/or modified sequence opt4 from hemagglutinin__InfluenzaA__AHC59125

SEQ ID NO: 163187 - RNA, 1701 nt, Artificial Sequence
  derived and/or modified sequence opt4 from hemagglutinin__InfluenzaA__AHC59137
augaagaccaucaucgcccugagcuacauccugugccugguguucgcccagaagauccccggcaacgacaacagcaccgccacccugugccugggccaccacgccgugagcaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163188 - RNA, 1701 nt, Artificial Sequence; identical to SEQ ID NO: 159502
  derived and/or modified sequence opt4 from hemagglutinin__InfluenzaA__AHC59149

SEQ ID NO: 163189 - RNA, 1701 nt, Artificial Sequence
  derived and/or modified sequence opt4 from hemagglutinin__InfluenzaA__AHC59185
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163190 - RNA, 1701 nt, Artificial Sequence; identical to SEQ ID NO: 159375
  derived and/or modified sequence opt4 from hemagglutinin__InfluenzaA__AHC59197

SEQ ID NO: 163191 - RNA, 1701 nt, Artificial Sequence
  derived and/or modified sequence opt4 from hemagglutinin__InfluenzaA__AHC59209
augaagaccaucaucgcccugagcuacauccugugccugguguucgcccaggagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacgacuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcgagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgccguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163192 - RNA, 1701 nt, Artificial Sequence; identical to SEQ ID NO: 159502
  derived and/or modified sequence opt4 from hemagglutinin__InfluenzaA__AHC59221

SEQ ID NO: 163193 - RNA, 1701 nt, Artificial Sequence; identical to SEQ ID NO: 163171
  derived and/or modified sequence opt4 from hemagglutinin__InfluenzaA__AHC59245

SEQ ID NO: 163194 - RNA, 1701 nt, Artificial Sequence; identical to SEQ ID NO: 163138
  derived and/or modified sequence opt4 from hemagglutinin__InfluenzaA__AHC59257

SEQ ID NO: 163195 - RNA, 1701 nt, Artificial Sequence; identical to SEQ ID NO: 160302
  derived and/or modified sequence opt4 from hemagglutinin__InfluenzaA__AHC59269

SEQ ID NO: 163196 - RNA, 1701 nt, Artificial Sequence; identical to SEQ ID NO: 163138
  derived and/or modified sequence opt4 from hemagglutinin__InfluenzaA__AHC59281

SEQ ID NO: 163197 - RNA, 1701 nt, Artificial Sequence; identical to SEQ ID NO: 159502
  derived and/or modified sequence opt4 from hemagglutinin__InfluenzaA__AHC59293

SEQ ID NO: 163198 - RNA, 1701 nt, Artificial Sequence
  derived and/or modified sequence opt4 from hemagglutinin__InfluenzaA__AHC59305
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcagcagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163199 - RNA, 1701 nt, Artificial Sequence
  derived and/or modified sequence opt4 from hemagglutinin__InfluenzaA__AHC59329
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgagaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163200 - RNA, 1701 nt, Artificial Sequence; identical to SEQ ID NO: 161594
  derived and/or modified sequence opt4 from hemagglutinin__InfluenzaA__AHC59341

SEQ ID NO: 163201 - RNA, 1701 nt, Artificial Sequence; identical to SEQ ID NO: 163138
  derived and/or modified sequence opt4 from hemagglutinin__InfluenzaA__AHC59365

SEQ ID NO: 163202 - RNA, 1701 nt, Artificial Sequence
  derived and/or modified sequence opt4 from hemagglutinin__InfluenzaA__AHC59377
augaagaccaucaucgcccugagcuacauccugugccugguguucgcccagaagcugcccggcaacgacaacagcaccgccacccugugccugggccaccacgccgugcccaacggcaccguggugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccagaaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163203 - RNA, 1701 nt, Artificial Sequence; identical to SEQ ID NO: 159502
  derived and/or modified sequence opt4 from hemagglutinin__InfluenzaA__AHC59413

SEQ ID NO: 163204 - RNA, 1701 nt, Artificial Sequence; identical to SEQ ID NO: 160302
  derived and/or modified sequence opt4 from hemagglutinin__InfluenzaA__AHC59425

SEQ ID NO: 163205 - RNA, 1701 nt, Artificial Sequence; identical to SEQ ID NO: 161594
  derived and/or modified sequence opt4 from hemagglutinin__InfluenzaA__AHC59437

SEQ ID NO: 163206 - RNA, 1701 nt, Artificial Sequence
  derived and/or modified sequence opt4 from hemagglutinin__InfluenzaA__AHC59449
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcagaaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163207 - RNA, 1701 nt, Artificial Sequence; identical to SEQ ID NO: 159375
  derived and/or modified sequence opt4 from hemagglutinin__InfluenzaA__AHC59461

SEQ ID NO: 163208 - RNA, 1701 nt, Artificial Sequence; identical to SEQ ID NO: 163199
  derived and/or modified sequence opt4 from hemagglutinin__InfluenzaA__AHC59473

SEQ ID NO: 163209 - RNA, 1701 nt, Artificial Sequence; identical to SEQ ID NO: 159502
  derived and/or modified sequence opt4 from hemagglutinin__InfluenzaA__AHC59485

SEQ ID NO: 163210 - RNA, 1701 nt, Artificial Sequence; identical to SEQ ID NO: 159502
  derived and/or modified sequence opt4 from hemagglutinin__InfluenzaA__AHC59497

SEQ ID NO: 163211 - RNA, 1701 nt, Artificial Sequence; identical to SEQ ID NO: 159375
  derived and/or modified sequence opt4 from hemagglutinin__InfluenzaA__AHC59509

SEQ ID NO: 163212 - RNA, 1701 nt, Artificial Sequence; identical to SEQ ID NO: 159375
  derived and/or modified sequence opt4 from hemagglutinin__InfluenzaA__AHC59521

SEQ ID NO: 163213 - RNA, 1701 nt, Artificial Sequence
  derived and/or modified sequence opt4 from hemagglutinin__InfluenzaA__AHC59533
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaagaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163214 - RNA, 1701 nt, Artificial Sequence; identical to SEQ ID NO: 159502
  derived and/or modified sequence opt4 from hemagglutinin__InfluenzaA__AHC59545

SEQ ID NO: 163215 - RNA, 1701 nt, Artificial Sequence; identical to SEQ ID NO: 163138
  derived and/or modified sequence opt4 from hemagglutinin__InfluenzaA__AHC59557

SEQ ID NO: 163216 - RNA, 1701 nt, Artificial Sequence
  derived and/or modified sequence opt4 from hemagglutinin__InfluenzaA__AHC59569
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163217 - RNA, 1701 nt, Artificial Sequence; identical to SEQ ID NO: 159502
  derived and/or modified sequence opt4 from hemagglutinin__InfluenzaA__AHC59581

SEQ ID NO: 163218 - RNA, 1701 nt, Artificial Sequence; identical to SEQ ID NO: 159375
  derived and/or modified sequence opt4 from hemagglutinin__InfluenzaA__AHC59593

SEQ ID NO: 163219 - RNA, 1701 nt, Artificial Sequence; identical to SEQ ID NO: 161594
  derived and/or modified sequence opt4 from hemagglutinin__InfluenzaA__AHC59605

SEQ ID NO: 163220 - RNA, 1701 nt, Artificial Sequence; identical to SEQ ID NO: 159502
  derived and/or modified sequence opt4 from hemagglutinin__InfluenzaA__AHC59617

SEQ ID NO: 163221 - RNA, 1701 nt, Artificial Sequence; identical to SEQ ID NO: 159502
  derived and/or modified sequence opt4 from hemagglutinin__InfluenzaA__AHC59629

SEQ ID NO: 163222 - RNA, 1701 nt, Artificial Sequence; identical to SEQ ID NO: 163138
  derived and/or modified sequence opt4 from hemagglutinin__InfluenzaA__AHC59641

SEQ ID NO: 163223 - RNA, 1701 nt, Artificial Sequence
  derived and/or modified sequence opt4 from hemagglutinin__InfluenzaA__AHC59653
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcacccagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163224 - RNA, 1701 nt, Artificial Sequence; identical to SEQ ID NO: 159375
  derived and/or modified sequence opt4 from hemagglutinin__InfluenzaA__AHC59665

SEQ ID NO: 163225 - RNA, 1701 nt, Artificial Sequence; identical to SEQ ID NO: 159502
  derived and/or modified sequence opt4 from hemagglutinin__InfluenzaA__AHC59677

SEQ ID NO: 163226 - RNA, 1701 nt, Artificial Sequence; identical to SEQ ID NO: 163223
  derived and/or modified sequence opt4 from hemagglutinin__InfluenzaA__AHC59689

SEQ ID NO: 163227 - RNA, 1701 nt, Artificial Sequence; identical to SEQ ID NO: 163138
  derived and/or modified sequence opt4 from hemagglutinin__InfluenzaA__AHC59701

SEQ ID NO: 163228 - RNA, 1701 nt, Artificial Sequence; identical to SEQ ID NO: 159375
  derived and/or modified sequence opt4 from hemagglutinin__InfluenzaA__AHC59713

SEQ ID NO: 163229 - RNA, 1701 nt, Artificial Sequence; identical to SEQ ID NO: 163149
  derived and/or modified sequence opt4 from hemagglutinin__InfluenzaA__AHC59737

SEQ ID NO: 163230 - RNA, 1701 nt, Artificial Sequence; identical to SEQ ID NO: 159375
  derived and/or modified sequence opt4 from hemagglutinin__InfluenzaA__AHC59749

SEQ ID NO: 163231 - RNA, 1701 nt, Artificial Sequence; identical to SEQ ID NO: 159502
  derived and/or modified sequence opt4 from hemagglutinin__InfluenzaA__AHC59761

SEQ ID NO: 163232 - RNA, 1701 nt, Artificial Sequence; identical to SEQ ID NO: 159502
  derived and/or modified sequence opt4 from hemagglutinin__InfluenzaA__AHC59773

SEQ ID NO: 163233 - RNA, 1701 nt, Artificial Sequence; identical to SEQ ID NO: 160302
  derived and/or modified sequence opt4 from hemagglutinin__InfluenzaA__AHC59785

SEQ ID NO: 163234 - RNA, 1701 nt, Artificial Sequence; identical to SEQ ID NO: 159502
  derived and/or modified sequence opt4 from hemagglutinin__InfluenzaA__AHC59797

SEQ ID NO: 163235 - RNA, 1701 nt, Artificial Sequence; identical to SEQ ID NO: 161594
  derived and/or modified sequence opt4 from hemagglutinin__InfluenzaA__AHC59809

SEQ ID NO: 163236 - RNA, 1701 nt, Artificial Sequence
  derived and/or modified sequence opt4 from hemagglutinin__InfluenzaA__AHC59821
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggccugcagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcugguggagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163237 - RNA, 1701 nt, Artificial Sequence; identical to SEQ ID NO: 163138
  derived and/or modified sequence opt4 from hemagglutinin__InfluenzaA__AHC59833

SEQ ID NO: 163238 - RNA, 1701 nt, Artificial Sequence; identical to SEQ ID NO: 163137
  derived and/or modified sequence opt4 from hemagglutinin__InfluenzaA__AHC59845

SEQ ID NO: 163239 - RNA, 1701 nt, Artificial Sequence; identical to SEQ ID NO: 160302
  derived and/or modified sequence opt4 from hemagglutinin__InfluenzaA__AHC59857

SEQ ID NO: 163240 - RNA, 1701 nt, Artificial Sequence; identical to SEQ ID NO: 159502
  derived and/or modified sequence opt4 from hemagglutinin__InfluenzaA__AHC59869

SEQ ID NO: 163241 - RNA, 1701 nt, Artificial Sequence; identical to SEQ ID NO: 159502
  derived and/or modified sequence opt4 from hemagglutinin__InfluenzaA__AHC59881

SEQ ID NO: 163242 - RNA, 1701 nt, Artificial Sequence; identical to SEQ ID NO: 159375
  derived and/or modified sequence opt4 from hemagglutinin__InfluenzaA__AHC59892

SEQ ID NO: 163243 - RNA, 1701 nt, Artificial Sequence
  derived and/or modified sequence opt4 from hemagglutinin__InfluenzaA__AHC59904
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163244 - RNA, 1701 nt, Artificial Sequence
  derived and/or modified sequence opt4 from hemagglutinin__InfluenzaA__AHC59915
augaagaccgugaucgcccugagcuacauccugugccuggccuucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163245 - RNA, 1701 nt, Artificial Sequence; identical to SEQ ID NO: 159502
  derived and/or modified sequence opt4 from hemagglutinin__InfluenzaA__AHC59939

SEQ ID NO: 163246 - RNA, 1701 nt, Artificial Sequence
  derived and/or modified sequence opt4 from hemagglutinin__InfluenzaA__AHC59963
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacaucaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163247 - RNA, 1701 nt, Artificial Sequence; identical to SEQ ID NO: 159375
  derived and/or modified sequence opt4 from hemagglutinin__InfluenzaA__AHC59987

SEQ ID NO: 163248 - RNA, 1701 nt, Artificial Sequence; identical to SEQ ID NO: 159375
  derived and/or modified sequence opt4 from hemagglutinin__InfluenzaA__AHC59999

SEQ ID NO: 163249 - RNA, 1701 nt, Artificial Sequence; identical to SEQ ID NO: 159502
  derived and/or modified sequence opt4 from hemagglutinin__InfluenzaA__AHC60011

SEQ ID NO: 163250 - RNA, 1701 nt, Artificial Sequence; identical to SEQ ID NO: 159375
  derived and/or modified sequence opt4 from hemagglutinin__InfluenzaA__AHC60023

SEQ ID NO: 163251 - RNA, 1701 nt, Artificial Sequence; identical to SEQ ID NO: 160302
  derived and/or modified sequence opt4 from hemagglutinin__InfluenzaA__AHC60035

SEQ ID NO: 163252 - RNA, 1701 nt, Artificial Sequence; identical to SEQ ID NO: 160302
  derived and/or modified sequence opt4 from hemagglutinin__InfluenzaA__AHC60047

SEQ ID NO: 163253 - RNA, 1701 nt, Artificial Sequence
  derived and/or modified sequence opt4 from hemagglutinin__InfluenzaA__AHC60059
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163254 - RNA, 1701 nt, Artificial Sequence; identical to SEQ ID NO: 161594
  derived and/or modified sequence opt4 from hemagglutinin__InfluenzaA__AHC60071

SEQ ID NO: 163255 - RNA, 1701 nt, Artificial Sequence; identical to SEQ ID NO: 163138
  derived and/or modified sequence opt4 from hemagglutinin__InfluenzaA__AHC60083

SEQ ID NO: 163256 - RNA, 1701 nt, Artificial Sequence; identical to SEQ ID NO: 160302
  derived and/or modified sequence opt4 from hemagglutinin__InfluenzaA__AHC60095

SEQ ID NO: 163257 - RNA, 1701 nt, Artificial Sequence
  derived and/or modified sequence opt4 from hemagglutinin__InfluenzaA__AHC60107
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagaucaucgacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauucaagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163258 - RNA, 1701 nt, Artificial Sequence; identical to SEQ ID NO: 159502
  derived and/or modified sequence opt4 from hemagglutinin__InfluenzaA__AHC60119

SEQ ID NO: 163259 - RNA, 1701 nt, Artificial Sequence; identical to SEQ ID NO: 159502
  derived and/or modified sequence opt4 from hemagglutinin__InfluenzaA__AHC60131

SEQ ID NO: 163260 - RNA, 1701 nt, Artificial Sequence; identical to SEQ ID NO: 163168
  derived and/or modified sequence opt4 from hemagglutinin__InfluenzaA__AHC60143

SEQ ID NO: 163261 - RNA, 1701 nt, Artificial Sequence
  derived and/or modified sequence opt4 from hemagglutinin__InfluenzaA__AHC60155
augaagaccgugaucgcccugagcuacauccugugccuggccuucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagccccaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163262 - RNA, 1701 nt, Artificial Sequence; identical to SEQ ID NO: 159375
  derived and/or modified sequence opt4 from hemagglutinin__InfluenzaA__AHC60167

SEQ ID NO: 163263 - RNA, 1701 nt, Artificial Sequence; identical to SEQ ID NO: 160302
  derived and/or modified sequence opt4 from hemagglutinin__InfluenzaA__AHC60179

SEQ ID NO: 163264 - RNA, 1701 nt, Artificial Sequence; identical to SEQ ID NO: 163213
  derived and/or modified sequence opt4 from hemagglutinin__InfluenzaA__AHC60191

SEQ ID NO: 163265 - RNA, 1701 nt, Artificial Sequence; identical to SEQ ID NO: 163213
  derived and/or modified sequence opt4 from hemagglutinin__InfluenzaA__AHC60203

SEQ ID NO: 163266 - RNA, 1701 nt, Artificial Sequence; identical to SEQ ID NO: 161594
  derived and/or modified sequence opt4 from hemagglutinin__InfluenzaA__AHC60215

SEQ ID NO: 163267 - RNA, 1701 nt, Artificial Sequence; identical to SEQ ID NO: 160302
  derived and/or modified sequence opt4 from hemagglutinin__InfluenzaA__AHC60239

SEQ ID NO: 163268 - RNA, 1701 nt, Artificial Sequence; identical to SEQ ID NO: 160302
  derived and/or modified sequence opt4 from hemagglutinin__InfluenzaA__AHC60251

SEQ ID NO: 163269 - RNA, 1701 nt, Artificial Sequence
  derived and/or modified sequence opt4 from hemagglutinin__InfluenzaA__AHC60263
augaagaccaucaucgcccugagcuacauccugugccugguguucgcccagaagcugcccggcaacgagaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163270 - RNA, 1701 nt, Artificial Sequence; identical to SEQ ID NO: 159375
  derived and/or modified sequence opt4 from hemagglutinin__InfluenzaA__AHC60275

SEQ ID NO: 163271 - RNA, 1701 nt, Artificial Sequence; identical to SEQ ID NO: 163257
  derived and/or modified sequence opt4 from hemagglutinin__InfluenzaA__AHC60287

SEQ ID NO: 163272 - RNA, 1701 nt, Artificial Sequence; identical to SEQ ID NO: 163138
  derived and/or modified sequence opt4 from hemagglutinin__InfluenzaA__AHC60299

SEQ ID NO: 163273 - RNA, 1701 nt, Artificial Sequence
  derived and/or modified sequence opt4 from hemagglutinin__InfluenzaA__AHC60311
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucgacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163274 - RNA, 1701 nt, Artificial Sequence; identical to SEQ ID NO: 160302
  derived and/or modified sequence opt4 from hemagglutinin__InfluenzaA__AHC60323

SEQ ID NO: 163275 - RNA, 1701 nt, Artificial Sequence; identical to SEQ ID NO: 161594
  derived and/or modified sequence opt4 from hemagglutinin__InfluenzaA__AHC60335

SEQ ID NO: 163276 - RNA, 1701 nt, Artificial Sequence; identical to SEQ ID NO: 159375
  derived and/or modified sequence opt4 from hemagglutinin__InfluenzaA__AHC60347

SEQ ID NO: 163277 - RNA, 1701 nt, Artificial Sequence; identical to SEQ ID NO: 159502
  derived and/or modified sequence opt4 from hemagglutinin__InfluenzaA__AHC60359

SEQ ID NO: 163278 - RNA, 1701 nt, Artificial Sequence; identical to SEQ ID NO: 163199
  derived and/or modified sequence opt4 from hemagglutinin__InfluenzaA__AHC60371

SEQ ID NO: 163279 - RNA, 1701 nt, Artificial Sequence; identical to SEQ ID NO: 159375
  derived and/or modified sequence opt4 from hemagglutinin__InfluenzaA__AHC60383

SEQ ID NO: 163280 - RNA, 1701 nt, Artificial Sequence; identical to SEQ ID NO: 159502
  derived and/or modified sequence opt4 from hemagglutinin__InfluenzaA__AHC60395

SEQ ID NO: 163281 - RNA, 1701 nt, Artificial Sequence; identical to SEQ ID NO: 163213
  derived and/or modified sequence opt4 from hemagglutinin__InfluenzaA__AHC60407

SEQ ID NO: 163282 - RNA, 1701 nt, Artificial Sequence; identical to SEQ ID NO: 159375
  derived and/or modified sequence opt4 from hemagglutinin__InfluenzaA__AHC60419

SEQ ID NO: 163283 - RNA, 1701 nt, Artificial Sequence; identical to SEQ ID NO: 159502
  derived and/or modified sequence opt4 from hemagglutinin__InfluenzaA__AHC60431

SEQ ID NO: 163284 - RNA, 1701 nt, Artificial Sequence; identical to SEQ ID NO: 159375
  derived and/or modified sequence opt4 from hemagglutinin__InfluenzaA__AHC60455

SEQ ID NO: 163285 - RNA, 1701 nt, Artificial Sequence; identical to SEQ ID NO: 159375
  derived and/or modified sequence opt4 from hemagglutinin__InfluenzaA__AHC60467

SEQ ID NO: 163286 - RNA, 1701 nt, Artificial Sequence; identical to SEQ ID NO: 163137
  derived and/or modified sequence opt4 from hemagglutinin__InfluenzaA__AHC60479

SEQ ID NO: 163287 - RNA, 1701 nt, Artificial Sequence; identical to SEQ ID NO: 160302
  derived and/or modified sequence opt4 from hemagglutinin__InfluenzaA__AHC60491

SEQ ID NO: 163288 - RNA, 1701 nt, Artificial Sequence
  derived and/or modified sequence opt4 from hemagglutinin__InfluenzaA__AHC60503
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 163289 - RNA, 1701 nt, Artificial Sequence; identical to SEQ ID NO: 159502
  derived and/or modified sequence opt4 from hemagglutinin__InfluenzaA__AHC60515

SEQ ID NO: 163290 - RNA, 1701 nt, Artificial Sequence; identical to SEQ ID NO: 160302
  derived and/or modified sequence opt4 from hemagglutinin__InfluenzaA__AHC60527

SEQ ID NO: 163291 - RNA, 1701 nt, Artificial Sequence; identical to SEQ ID NO: 159502
  derived and/or modified sequence opt4 from hemagglutinin__InfluenzaA__AHC60539

SEQ ID NO: 163292 - RNA, 1701 nt, Artificial Sequence; identical to SEQ ID NO: 163149
  derived and/or modified sequence opt4 from hemagglutinin__InfluenzaA__AHC60551

SEQ ID NO: 163293 - RNA, 1701 nt, Artificial Sequence; identical to SEQ ID NO: 161594
  derived and/or modified sequence opt4 from hemagglutinin__InfluenzaA__AHC60563

SEQ ID NO: 163294 - RNA, 1701 nt, Artificial Sequence; identical to SEQ ID NO: 161594
  derived and/or modified sequence opt4 from hemagglutinin__InfluenzaA__AHC60575

SEQ ID NO: 163295 - RNA, 1701 nt, Artificial Sequence
  derived and/or modified sequence opt4 from hemagglutinin__InfluenzaA__AHC60587
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccagaaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163296 - RNA, 1701 nt, Artificial Sequence; identical to SEQ ID NO: 161594
  derived and/or modified sequence opt4 from hemagglutinin__InfluenzaA__AHC60599

SEQ ID NO: 163297 - RNA, 1701 nt, Artificial Sequence; identical to SEQ ID NO: 159375
  derived and/or modified sequence opt4 from hemagglutinin__InfluenzaA__AHC60611

SEQ ID NO: 163298 - RNA, 1701 nt, Artificial Sequence
  derived and/or modified sequence opt4 from hemagglutinin__InfluenzaA__AHC60623
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163299 - RNA, 1701 nt, Artificial Sequence; identical to SEQ ID NO: 161594
  derived and/or modified sequence opt4 from hemagglutinin__InfluenzaA__AHC60635

SEQ ID NO: 163300 - RNA, 1701 nt, Artificial Sequence
  derived and/or modified sequence opt4 from hemagglutinin__InfluenzaA__AHC60647
augaagaccaucaucgcccugagcuacauccugugccugguguucacccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163301 - RNA, 1701 nt, Artificial Sequence
  derived and/or modified sequence opt4 from hemagglutinin__InfluenzaA__AHC60659
augaagaccaucaucgcccugagcuacauccugugccugguguucacccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163302 - RNA, 1701 nt, Artificial Sequence
  derived and/or modified sequence opt4 from hemagglutinin__InfluenzaA__AHC60671
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaaggagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163303 - RNA, 1701 nt, Artificial Sequence
  derived and/or modified sequence opt4 from hemagglutinin__InfluenzaA__AHC60683
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaucagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163304 - RNA, 1701 nt, Artificial Sequence
  derived and/or modified sequence opt4 from hemagglutinin__InfluenzaA__AHC60695
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaugagaggcagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163305 - RNA, 1701 nt, Artificial Sequence
  derived and/or modified sequence opt4 from hemagglutinin__InfluenzaA__AHC60707
augaagaccaucaucgcccugagcuacauccugugccugguguucgcccagaagcugcccggcaacgacaacagcaccgccacccugugccugggccaccacgccgugcccaacggcaccaucgugaagaccaucaccgacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggaucaucuggaucagcuucgccaucagcugcuuccugcugugcguggcccugcugggcuucaucaugugggccugccagaagggcaacaucagaugcaacaucugcaucuga

SEQ ID NO: 163306 - RNA, 1701 nt, Artificial Sequence; identical to SEQ ID NO: 159375
  derived and/or modified sequence opt4 from hemagglutinin__InfluenzaA__AHC60719

SEQ ID NO: 163307 - RNA, 1701 nt, Artificial Sequence; identical to SEQ ID NO: 159502
  derived and/or modified sequence opt4 from hemagglutinin__InfluenzaA__AHC60731

SEQ ID NO: 163308 - RNA, 1701 nt, Artificial Sequence; identical to SEQ ID NO: 163213
  derived and/or modified sequence opt4 from hemagglutinin__InfluenzaA__AHC60743

SEQ ID NO: 163309 - RNA, 1701 nt, Artificial Sequence; identical to SEQ ID NO: 155931
  derived and/or modified sequence opt4 from hemagglutinin__InfluenzaA__AHC60767

SEQ ID NO: 163310 - RNA, 1701 nt, Artificial Sequence
  derived and/or modified sequence opt4 from hemagglutinin__InfluenzaA__AHC60779
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagauucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163311 - RNA, 1701 nt, Artificial Sequence; identical to SEQ ID NO: 159502
  derived and/or modified sequence opt4 from hemagglutinin__InfluenzaA__AHC60791

SEQ ID NO: 163312 - RNA, 1701 nt, Artificial Sequence; identical to SEQ ID NO: 163171
  derived and/or modified sequence opt4 from hemagglutinin__InfluenzaA__AHC60803

SEQ ID NO: 163313 - RNA, 1701 nt, Artificial Sequence; identical to SEQ ID NO: 159375
  derived and/or modified sequence opt4 from hemagglutinin__InfluenzaA__AHC60815

SEQ ID NO: 163314 - RNA, 1701 nt, Artificial Sequence
  derived and/or modified sequence opt4 from hemagglutinin__InfluenzaA__AHC60827
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccgacgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163315 - RNA, 1701 nt, Artificial Sequence; identical to SEQ ID NO: 163149
  derived and/or modified sequence opt4 from hemagglutinin__InfluenzaA__AHC60839

SEQ ID NO: 163316 - RNA, 1701 nt, Artificial Sequence; identical to SEQ ID NO: 159502
  derived and/or modified sequence opt4 from hemagglutinin__InfluenzaA__AHC60851

SEQ ID NO: 163317 - RNA, 1701 nt, Artificial Sequence
  derived and/or modified sequence opt4 from hemagglutinin__InfluenzaA__AHC60863
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaaggccggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163318 - RNA, 1701 nt, Artificial Sequence; identical to SEQ ID NO: 159502
  derived and/or modified sequence opt4 from hemagglutinin__InfluenzaA__AHC60875

SEQ ID NO: 163319 - RNA, 1701 nt, Artificial Sequence; identical to SEQ ID NO: 159502
  derived and/or modified sequence opt4 from hemagglutinin__InfluenzaA__AHC60887

SEQ ID NO: 163320 - RNA, 1701 nt, Artificial Sequence; identical to SEQ ID NO: 155931
  derived and/or modified sequence opt4 from hemagglutinin__InfluenzaA__AHC60899

SEQ ID NO: 163321 - RNA, 1701 nt, Artificial Sequence; identical to SEQ ID NO: 160302
  derived and/or modified sequence opt4 from hemagglutinin__InfluenzaA__AHC60911

SEQ ID NO: 163322 - RNA, 1701 nt, Artificial Sequence; identical to SEQ ID NO: 163138
  derived and/or modified sequence opt4 from hemagglutinin__InfluenzaA__AHC60923

SEQ ID NO: 163323 - RNA, 1701 nt, Artificial Sequence; identical to SEQ ID NO: 160302
  derived and/or modified sequence opt4 from hemagglutinin__InfluenzaA__AHC60935

SEQ ID NO: 163324 - RNA, 1701 nt, Artificial Sequence; identical to SEQ ID NO: 159502
  derived and/or modified sequence opt4 from hemagglutinin__InfluenzaA__AHC60947

SEQ ID NO: 163325 - RNA, 1701 nt, Artificial Sequence; identical to SEQ ID NO: 160302
  derived and/or modified sequence opt4 from hemagglutinin__InfluenzaA__AHC60959

SEQ ID NO: 163326 - RNA, 1701 nt, Artificial Sequence; identical to SEQ ID NO: 159375
  derived and/or modified sequence opt4 from hemagglutinin__InfluenzaA__AHC60971

SEQ ID NO: 163327 - RNA, 1701 nt, Artificial Sequence; identical to SEQ ID NO: 160302
  derived and/or modified sequence opt4 from hemagglutinin__InfluenzaA__AHC60983

SEQ ID NO: 163328 - RNA, 1701 nt, Artificial Sequence; identical to SEQ ID NO: 159502
  derived and/or modified sequence opt4 from hemagglutinin__InfluenzaA__AHC61007

SEQ ID NO: 163329 - RNA, 1701 nt, Artificial Sequence; identical to SEQ ID NO: 159375
  derived and/or modified sequence opt4 from hemagglutinin__InfluenzaA__AHC61019

SEQ ID NO: 163330 - RNA, 1701 nt, Artificial Sequence
  derived and/or modified sequence opt4 from hemagglutinin__InfluenzaA__AHC61031
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 163331 - RNA, 1701 nt, Artificial Sequence; identical to SEQ ID NO: 160302
  derived and/or modified sequence opt4 from hemagglutinin__InfluenzaA__AHC61043

SEQ ID NO: 163332 - RNA, 1701 nt, Artificial Sequence
  derived and/or modified sequence opt4 from hemagglutinin__InfluenzaA__AHC61055
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccagaaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163333 - RNA, 1701 nt, Artificial Sequence; identical to SEQ ID NO: 163199
  derived and/or modified sequence opt4 from hemagglutinin__InfluenzaA__AHC61067

SEQ ID NO: 163334 - RNA, 1701 nt, Artificial Sequence; identical to SEQ ID NO: 161594
  derived and/or modified sequence opt4 from hemagglutinin__InfluenzaA__AHC61079

SEQ ID NO: 163335 - RNA, 1701 nt, Artificial Sequence; identical to SEQ ID NO: 159502
  derived and/or modified sequence opt4 from hemagglutinin__InfluenzaA__AHC61103

SEQ ID NO: 163336 - RNA, 1701 nt, Artificial Sequence; identical to SEQ ID NO: 159502
  derived and/or modified sequence opt4 from hemagglutinin__InfluenzaA__AHC61115

SEQ ID NO: 163337 - RNA, 1701 nt, Artificial Sequence; identical to SEQ ID NO: 160302
  derived and/or modified sequence opt4 from hemagglutinin__InfluenzaA__AHC61127

SEQ ID NO: 163338 - RNA, 1701 nt, Artificial Sequence
  derived and/or modified sequence opt4 from hemagglutinin__InfluenzaA__AHC61139
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcacccagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163339 - RNA, 1701 nt, Artificial Sequence; identical to SEQ ID NO: 159502
  derived and/or modified sequence opt4 from hemagglutinin__InfluenzaA__AHC61151

SEQ ID NO: 163340 - RNA, 1701 nt, Artificial Sequence
  derived and/or modified sequence opt4 from hemagglutinin__InfluenzaA__AHC61163
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaagaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccguggugcccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163341 - RNA, 1701 nt, Artificial Sequence; identical to SEQ ID NO: 160302
  derived and/or modified sequence opt4 from hemagglutinin__InfluenzaA__AHC61175

SEQ ID NO: 163342 - RNA, 1701 nt, Artificial Sequence; identical to SEQ ID NO: 159502
  derived and/or modified sequence opt4 from hemagglutinin__InfluenzaA__AHC61187

SEQ ID NO: 163343 - RNA, 1701 nt, Artificial Sequence; identical to SEQ ID NO: 159375
  derived and/or modified sequence opt4 from hemagglutinin__InfluenzaA__AHC61199

SEQ ID NO: 163344 - RNA, 1701 nt, Artificial Sequence; identical to SEQ ID NO: 163138
  derived and/or modified sequence opt4 from hemagglutinin__InfluenzaA__AHC61211

SEQ ID NO: 163345 - RNA, 1701 nt, Artificial Sequence; identical to SEQ ID NO: 159375
  derived and/or modified sequence opt4 from hemagglutinin__InfluenzaA__AHC61223

SEQ ID NO: 163346 - RNA, 1701 nt, Artificial Sequence; identical to SEQ ID NO: 159502
  derived and/or modified sequence opt4 from hemagglutinin__InfluenzaA__AHC61235

SEQ ID NO: 163347 - RNA, 1701 nt, Artificial Sequence; identical to SEQ ID NO: 160302
  derived and/or modified sequence opt4 from hemagglutinin__InfluenzaA__AHC61247

SEQ ID NO: 163348 - RNA, 1701 nt, Artificial Sequence; identical to SEQ ID NO: 160302
  derived and/or modified sequence opt4 from hemagglutinin__InfluenzaA__AHC61259

SEQ ID NO: 163349 - RNA, 1701 nt, Artificial Sequence; identical to SEQ ID NO: 159502
  derived and/or modified sequence opt4 from hemagglutinin__InfluenzaA__AHC61271

SEQ ID NO: 163350 - RNA, 1701 nt, Artificial Sequence; identical to SEQ ID NO: 159375
  derived and/or modified sequence opt4 from hemagglutinin__InfluenzaA__AHC61283

SEQ ID NO: 163351 - RNA, 1701 nt, Artificial Sequence; identical to SEQ ID NO: 161594
  derived and/or modified sequence opt4 from hemagglutinin__InfluenzaA__AHC61295

SEQ ID NO: 163352 - RNA, 1701 nt, Artificial Sequence; identical to SEQ ID NO: 163206
  derived and/or modified sequence opt4 from hemagglutinin__InfluenzaA__AHC61307

SEQ ID NO: 163353 - RNA, 1701 nt, Artificial Sequence; identical to SEQ ID NO: 159502
  derived and/or modified sequence opt4 from hemagglutinin__InfluenzaA__AHC61319

SEQ ID NO: 163354 - RNA, 1701 nt, Artificial Sequence; identical to SEQ ID NO: 163138
  derived and/or modified sequence opt4 from hemagglutinin__InfluenzaA__AHC61331

SEQ ID NO: 163355 - RNA, 1701 nt, Artificial Sequence
  derived and/or modified sequence opt4 from hemagglutinin__InfluenzaA__AHC61343
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163356 - RNA, 1701 nt, Artificial Sequence; identical to SEQ ID NO: 159375
  derived and/or modified sequence opt4 from hemagglutinin__InfluenzaA__AHC61355

SEQ ID NO: 163357 - RNA, 1701 nt, Artificial Sequence; identical to SEQ ID NO: 159375
  derived and/or modified sequence opt4 from hemagglutinin__InfluenzaA__AHC61367

SEQ ID NO: 163358 - RNA, 1701 nt, Artificial Sequence; identical to SEQ ID NO: 159502
  derived and/or modified sequence opt4 from hemagglutinin__InfluenzaA__AHC61379

SEQ ID NO: 163359 - RNA, 1701 nt, Artificial Sequence; identical to SEQ ID NO: 159375
  derived and/or modified sequence opt4 from hemagglutinin__InfluenzaA__AHC61391

SEQ ID NO: 163360 - RNA, 1701 nt, Artificial Sequence
  derived and/or modified sequence opt4 from hemagglutinin__InfluenzaA__AHC61403
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugcagcagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163361 - RNA, 1701 nt, Artificial Sequence; identical to SEQ ID NO: 159502
  derived and/or modified sequence opt4 from hemagglutinin__InfluenzaA__AHC61415

SEQ ID NO: 163362 - RNA, 1701 nt, Artificial Sequence
  derived and/or modified sequence opt4 from hemagglutinin__InfluenzaA__AHC61427
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaacaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaucagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163363 - RNA, 1701 nt, Artificial Sequence
  derived and/or modified sequence opt4 from hemagglutinin__InfluenzaA__AHC61439
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcaccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163364 - RNA, 1701 nt, Artificial Sequence; identical to SEQ ID NO: 159375
  derived and/or modified sequence opt4 from hemagglutinin__InfluenzaA__AHC61451

SEQ ID NO: 163365 - RNA, 1701 nt, Artificial Sequence; identical to SEQ ID NO: 159375
  derived and/or modified sequence opt4 from hemagglutinin__InfluenzaA__AHC61463

SEQ ID NO: 163366 - RNA, 1701 nt, Artificial Sequence; identical to SEQ ID NO: 160302
  derived and/or modified sequence opt4 from hemagglutinin__InfluenzaA__AHC61475

SEQ ID NO: 163367 - RNA, 1701 nt, Artificial Sequence; identical to SEQ ID NO: 159502
  derived and/or modified sequence opt4 from hemagglutinin__InfluenzaA__AHC61487

SEQ ID NO: 163368 - RNA, 1701 nt, Artificial Sequence; identical to SEQ ID NO: 160302
  derived and/or modified sequence opt4 from hemagglutinin__InfluenzaA__AHC61499

SEQ ID NO: 163369 - RNA, 1701 nt, Artificial Sequence; identical to SEQ ID NO: 159375
  derived and/or modified sequence opt4 from hemagglutinin__InfluenzaA__AHC61511

SEQ ID NO: 163370 - RNA, 1701 nt, Artificial Sequence; identical to SEQ ID NO: 161594
  derived and/or modified sequence opt4 from hemagglutinin__InfluenzaA__AHC61523

SEQ ID NO: 163371 - RNA, 1701 nt, Artificial Sequence
  derived and/or modified sequence opt4 from hemagglutinin__InfluenzaA__AHC61535
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaccaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163372 - RNA, 1701 nt, Artificial Sequence; identical to SEQ ID NO: 159375
  derived and/or modified sequence opt4 from hemagglutinin__InfluenzaA__AHC61547

SEQ ID NO: 163373 - RNA, 1701 nt, Artificial Sequence
  derived and/or modified sequence opt4 from hemagglutinin__InfluenzaA__AHC61559
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagaucaucgacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucagaaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggccacaaggacuggauccuguggaucagcuucgccaucagcugcuuccugcugugcguggcccugcugggcuucaucaugugggccugccagaagggcaacaucagaugcaacaucugcaucuga

SEQ ID NO: 163374 - RNA, 1701 nt, Artificial Sequence; identical to SEQ ID NO: 161594
  derived and/or modified sequence opt4 from hemagglutinin__InfluenzaA__AHC61571

SEQ ID NO: 163375 - RNA, 1701 nt, Artificial Sequence; identical to SEQ ID NO: 159375
  derived and/or modified sequence opt4 from hemagglutinin__InfluenzaA__AHC61583

SEQ ID NO: 163376 - RNA, 1701 nt, Artificial Sequence; identical to SEQ ID NO: 161594
  derived and/or modified sequence opt4 from hemagglutinin__InfluenzaA__AHC61595

SEQ ID NO: 163377 - RNA, 1701 nt, Artificial Sequence
  derived and/or modified sequence opt4 from hemagglutinin__InfluenzaA__AHC61607
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagcacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163378 - RNA, 1701 nt, Artificial Sequence; identical to SEQ ID NO: 161594
  derived and/or modified sequence opt4 from hemagglutinin__InfluenzaA__AHC61619

SEQ ID NO: 163379 - RNA, 1701 nt, Artificial Sequence
  derived and/or modified sequence opt4 from hemagglutinin__InfluenzaA__AHC61631
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcaccaucaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163380 - RNA, 1701 nt, Artificial Sequence
  derived and/or modified sequence opt4 from hemagglutinin__InfluenzaA__AHC61643
augaagaccaucaucgcccugagcuacgugcugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163381 - RNA, 1701 nt, Artificial Sequence
  derived and/or modified sequence opt4 from hemagglutinin__InfluenzaA__AHC61655
augaagaccaucaucgcccugagcuacauccugugccugguguucacccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaacaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaucagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163382 - RNA, 1701 nt, Artificial Sequence
  derived and/or modified sequence opt4 from hemagglutinin__InfluenzaA__AHC61667
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163383 - RNA, 1701 nt, Artificial Sequence; identical to SEQ ID NO: 163138
  derived and/or modified sequence opt4 from hemagglutinin__InfluenzaA__AHC61679

SEQ ID NO: 163384 - RNA, 1701 nt, Artificial Sequence; identical to SEQ ID NO: 161594
  derived and/or modified sequence opt4 from hemagglutinin__InfluenzaA__AHC61691

SEQ ID NO: 163385 - RNA, 1701 nt, Artificial Sequence; identical to SEQ ID NO: 159375
  derived and/or modified sequence opt4 from hemagglutinin__InfluenzaA__AHC61703

SEQ ID NO: 163386 - RNA, 1701 nt, Artificial Sequence; identical to SEQ ID NO: 163171
  derived and/or modified sequence opt4 from hemagglutinin__InfluenzaA__AHC61715

SEQ ID NO: 163387 - RNA, 1701 nt, Artificial Sequence; identical to SEQ ID NO: 160302
  derived and/or modified sequence opt4 from hemagglutinin__InfluenzaA__AHC61727

SEQ ID NO: 163388 - RNA, 1701 nt, Artificial Sequence; identical to SEQ ID NO: 159375
  derived and/or modified sequence opt4 from hemagglutinin__InfluenzaA__AHC61739

SEQ ID NO: 163389 - RNA, 1701 nt, Artificial Sequence
  derived and/or modified sequence opt4 from hemagglutinin__InfluenzaA__AHC61751
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacgugggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163390 - RNA, 1701 nt, Artificial Sequence
  derived and/or modified sequence opt4 from hemagglutinin__InfluenzaA__AHC61763
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcagaccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163391 - RNA, 1701 nt, Artificial Sequence; identical to SEQ ID NO: 159502
  derived and/or modified sequence opt4 from hemagglutinin__InfluenzaA__AHC61775

SEQ ID NO: 163392 - RNA, 1701 nt, Artificial Sequence; identical to SEQ ID NO: 160302
  derived and/or modified sequence opt4 from hemagglutinin__InfluenzaA__AHC61787

SEQ ID NO: 163393 - RNA, 1701 nt, Artificial Sequence; identical to SEQ ID NO: 163138
  derived and/or modified sequence opt4 from hemagglutinin__InfluenzaA__AHC61799

SEQ ID NO: 163394 - RNA, 1701 nt, Artificial Sequence
  derived and/or modified sequence opt4 from hemagglutinin__InfluenzaA__AHC61823
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugaagagcgacgcccccaucgacaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163395 - RNA, 1701 nt, Artificial Sequence; identical to SEQ ID NO: 160302
  derived and/or modified sequence opt4 from hemagglutinin__InfluenzaA__AHC61835

SEQ ID NO: 163396 - RNA, 1701 nt, Artificial Sequence; identical to SEQ ID NO: 159502
  derived and/or modified sequence opt4 from hemagglutinin__InfluenzaA__AHC61847

SEQ ID NO: 163397 - RNA, 1701 nt, Artificial Sequence; identical to SEQ ID NO: 159375
  derived and/or modified sequence opt4 from hemagglutinin__InfluenzaA__AHC61859

SEQ ID NO: 163398 - RNA, 1701 nt, Artificial Sequence; identical to SEQ ID NO: 160302
  derived and/or modified sequence opt4 from hemagglutinin__InfluenzaA__AHC61871

SEQ ID NO: 163399 - RNA, 1701 nt, Artificial Sequence
  derived and/or modified sequence opt4 from hemagglutinin__InfluenzaA__AHC61883
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccuggccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163400 - RNA, 1701 nt, Artificial Sequence; identical to SEQ ID NO: 159502
  derived and/or modified sequence opt4 from hemagglutinin__InfluenzaA__AHC61895

SEQ ID NO: 163401 - RNA, 1701 nt, Artificial Sequence; identical to SEQ ID NO: 159502
  derived and/or modified sequence opt4 from hemagglutinin__InfluenzaA__AHC61907

SEQ ID NO: 163402 - RNA, 1701 nt, Artificial Sequence
  derived and/or modified sequence opt4 from hemagglutinin__InfluenzaA__AHC61931
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaagggcuggauccuguggaucagcuucgccaucagcugcuuccugcugugcguggcccugcugggcuucaucaugugggccugccagaagggcaacaucagaugcaacaucugcaucuga

SEQ ID NO: 163403 - RNA, 1701 nt, Artificial Sequence; identical to SEQ ID NO: 160302
  derived and/or modified sequence opt4 from hemagglutinin__InfluenzaA__AHC61943

SEQ ID NO: 163404 - RNA, 1701 nt, Artificial Sequence; identical to SEQ ID NO: 161594
  derived and/or modified sequence opt4 from hemagglutinin__InfluenzaA__AHC61955

SEQ ID NO: 163405 - RNA, 1701 nt, Artificial Sequence; identical to SEQ ID NO: 160302
  derived and/or modified sequence opt4 from hemagglutinin__InfluenzaA__AHC61967

SEQ ID NO: 163406 - RNA, 1701 nt, Artificial Sequence; identical to SEQ ID NO: 159375
  derived and/or modified sequence opt4 from hemagglutinin__InfluenzaA__AHC61979

SEQ ID NO: 163407 - RNA, 1701 nt, Artificial Sequence; identical to SEQ ID NO: 159502
  derived and/or modified sequence opt4 from hemagglutinin__InfluenzaA__AHC61991

SEQ ID NO: 163408 - RNA, 1701 nt, Artificial Sequence; identical to SEQ ID NO: 163213
  derived and/or modified sequence opt4 from hemagglutinin__InfluenzaA__AHC62003

SEQ ID NO: 163409 - RNA, 1701 nt, Artificial Sequence; identical to SEQ ID NO: 160302
  derived and/or modified sequence opt4 from hemagglutinin__InfluenzaA__AHC62015

SEQ ID NO: 163410 - RNA, 1701 nt, Artificial Sequence; identical to SEQ ID NO: 161594
  derived and/or modified sequence opt4 from hemagglutinin__InfluenzaA__AHC62027

SEQ ID NO: 163411 - RNA, 1701 nt, Artificial Sequence
  derived and/or modified sequence opt4 from hemagglutinin__InfluenzaA__AHC62039
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugaagagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163412 - RNA, 1701 nt, Artificial Sequence
  derived and/or modified sequence opt4 from hemagglutinin__InfluenzaA__AHC62050
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacgugcccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163413 - RNA, 1701 nt, Artificial Sequence; identical to SEQ ID NO: 161594
  derived and/or modified sequence opt4 from hemagglutinin__InfluenzaA__AHC62062

SEQ ID NO: 163414 - RNA, 1701 nt, Artificial Sequence
  derived and/or modified sequence opt4 from hemagglutinin__InfluenzaA__AHC62074
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaaaccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163415 - RNA, 1701 nt, Artificial Sequence; identical to SEQ ID NO: 159375
  derived and/or modified sequence opt4 from hemagglutinin__InfluenzaA__AHC62086

SEQ ID NO: 163416 - RNA, 1701 nt, Artificial Sequence; identical to SEQ ID NO: 160302
  derived and/or modified sequence opt4 from hemagglutinin__InfluenzaA__AHC62098

SEQ ID NO: 163417 - RNA, 1701 nt, Artificial Sequence; identical to SEQ ID NO: 159375
  derived and/or modified sequence opt4 from hemagglutinin__InfluenzaA__AHC62110

SEQ ID NO: 163418 - RNA, 1701 nt, Artificial Sequence
  derived and/or modified sequence opt4 from hemagglutinin__InfluenzaA__AHC62122
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagauggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcaacaacagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauucagaaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163419 - RNA, 1701 nt, Artificial Sequence; identical to SEQ ID NO: 159375
  derived and/or modified sequence opt4 from hemagglutinin__InfluenzaA__AHC62134

SEQ ID NO: 163420 - RNA, 1701 nt, Artificial Sequence
  derived and/or modified sequence opt4 from hemagglutinin__InfluenzaA__AHC62146
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacuacgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163421 - RNA, 1701 nt, Artificial Sequence; identical to SEQ ID NO: 159502
  derived and/or modified sequence opt4 from hemagglutinin__InfluenzaA__AHC62158

SEQ ID NO: 163422 - RNA, 1701 nt, Artificial Sequence
  derived and/or modified sequence opt4 from hemagglutinin__InfluenzaA__AHC62170
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163423 - RNA, 1701 nt, Artificial Sequence; identical to SEQ ID NO: 159375
  derived and/or modified sequence opt4 from hemagglutinin__InfluenzaA__AHC62182

SEQ ID NO: 163424 - RNA, 1701 nt, Artificial Sequence; identical to SEQ ID NO: 161594
  derived and/or modified sequence opt4 from hemagglutinin__InfluenzaA__AHC62194

SEQ ID NO: 163425 - RNA, 1701 nt, Artificial Sequence
  derived and/or modified sequence opt4 from hemagglutinin__InfluenzaA__AHC62206
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaucuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163426 - RNA, 1701 nt, Artificial Sequence; identical to SEQ ID NO: 159502
  derived and/or modified sequence opt4 from hemagglutinin__InfluenzaA__AHC62218

SEQ ID NO: 163427 - RNA, 1701 nt, Artificial Sequence
  derived and/or modified sequence opt4 from hemagglutinin__InfluenzaA__AHC62242
augaagaccaucaucgcccugagcuacauccugugccugguguucgcccagaagauccccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugaucgcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163428 - RNA, 1701 nt, Artificial Sequence; identical to SEQ ID NO: 163137
  derived and/or modified sequence opt4 from hemagglutinin__InfluenzaA__AHC62254

SEQ ID NO: 163429 - RNA, 1701 nt, Artificial Sequence; identical to SEQ ID NO: 159502
  derived and/or modified sequence opt4 from hemagglutinin__InfluenzaA__AHC62266

SEQ ID NO: 163430 - RNA, 1701 nt, Artificial Sequence; identical to SEQ ID NO: 163301
  derived and/or modified sequence opt4 from hemagglutinin__InfluenzaA__AHC62278

SEQ ID NO: 163431 - RNA, 1701 nt, Artificial Sequence
  derived and/or modified sequence opt4 from hemagglutinin__InfluenzaA__AHC62290
augaagaccaucaucgcccugagcuacauccugugccugaucuucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163432 - RNA, 1701 nt, Artificial Sequence
  derived and/or modified sequence opt4 from hemagglutinin__InfluenzaA__AHC62302
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163433 - RNA, 1701 nt, Artificial Sequence
  derived and/or modified sequence opt4 from hemagglutinin__InfluenzaA__AHC62314
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucagaggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163434 - RNA, 1701 nt, Artificial Sequence; identical to SEQ ID NO: 163298
  derived and/or modified sequence opt4 from hemagglutinin__InfluenzaA__AHC62326

SEQ ID NO: 163435 - RNA, 1701 nt, Artificial Sequence; identical to SEQ ID NO: 160302
  derived and/or modified sequence opt4 from hemagglutinin__InfluenzaA__AHC62338

SEQ ID NO: 163436 - RNA, 1701 nt, Artificial Sequence; identical to SEQ ID NO: 159375
  derived and/or modified sequence opt4 from hemagglutinin__InfluenzaA__AHC62350

SEQ ID NO: 163437 - RNA, 1701 nt, Artificial Sequence; identical to SEQ ID NO: 160302
  derived and/or modified sequence opt4 from hemagglutinin__InfluenzaA__AHC62362

SEQ ID NO: 163438 - RNA, 1701 nt, Artificial Sequence; identical to SEQ ID NO: 160302
  derived and/or modified sequence opt4 from hemagglutinin__InfluenzaA__AHC62374

SEQ ID NO: 163439 - RNA, 1701 nt, Artificial Sequence; identical to SEQ ID NO: 163301
  derived and/or modified sequence opt4 from hemagglutinin__InfluenzaA__AHC62386

SEQ ID NO: 163440 - RNA, 1701 nt, Artificial Sequence; identical to SEQ ID NO: 159375
  derived and/or modified sequence opt4 from hemagglutinin__InfluenzaA__AHC62398

SEQ ID NO: 163441 - RNA, 1701 nt, Artificial Sequence
  derived and/or modified sequence opt4 from hemagglutinin__InfluenzaA__AHC62410
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaucagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163442 - RNA, 1701 nt, Artificial Sequence; identical to SEQ ID NO: 163244
  derived and/or modified sequence opt4 from hemagglutinin__InfluenzaA__AHC62422

SEQ ID NO: 163443 - RNA, 1701 nt, Artificial Sequence
  derived and/or modified sequence opt4 from hemagglutinin__InfluenzaA__AHC62434
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163444 - RNA, 1701 nt, Artificial Sequence; identical to SEQ ID NO: 159375
  derived and/or modified sequence opt4 from hemagglutinin__InfluenzaA__AHC62446

SEQ ID NO: 163445 - RNA, 1701 nt, Artificial Sequence; identical to SEQ ID NO: 159502
  derived and/or modified sequence opt4 from hemagglutinin__InfluenzaA__AHC62458

SEQ ID NO: 163446 - RNA, 1701 nt, Artificial Sequence
  derived and/or modified sequence opt4 from hemagglutinin__InfluenzaA__AHC62470
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacggcaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163447 - RNA, 1701 nt, Artificial Sequence; identical to SEQ ID NO: 163199
  derived and/or modified sequence opt4 from hemagglutinin__InfluenzaA__AHC62482

SEQ ID NO: 163448 - RNA, 1701 nt, Artificial Sequence; identical to SEQ ID NO: 159375
  derived and/or modified sequence opt4 from hemagglutinin__InfluenzaA__AHC62506

SEQ ID NO: 163449 - RNA, 1701 nt, Artificial Sequence; identical to SEQ ID NO: 159502
  derived and/or modified sequence opt4 from hemagglutinin__InfluenzaA__AHC62518

SEQ ID NO: 163450 - RNA, 1701 nt, Artificial Sequence
  derived and/or modified sequence opt4 from hemagglutinin__InfluenzaA__AHC62530
augaagaccaucaucgcccugagcuacauccugugccugguguucgcccagaagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163451 - RNA, 1701 nt, Artificial Sequence; identical to SEQ ID NO: 163171
  derived and/or modified sequence opt4 from hemagglutinin__InfluenzaA__AHC62542

SEQ ID NO: 163452 - RNA, 1701 nt, Artificial Sequence; identical to SEQ ID NO: 159375
  derived and/or modified sequence opt4 from hemagglutinin__InfluenzaA__AHC62554

SEQ ID NO: 163453 - RNA, 1701 nt, Artificial Sequence
  derived and/or modified sequence opt4 from hemagglutinin__InfluenzaA__AHC62566
augaagaccaucaucgcccugagcuacauccugugccugguguucgcccagaagcugcccggcaacgacaacagcaccgccacccugugccugggccaccacgccgugcccaacggcaccauggugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163454 - RNA, 1701 nt, Artificial Sequence; identical to SEQ ID NO: 159375
  derived and/or modified sequence opt4 from hemagglutinin__InfluenzaA__AHC62578

SEQ ID NO: 163455 - RNA, 1701 nt, Artificial Sequence; identical to SEQ ID NO: 159375
  derived and/or modified sequence opt4 from hemagglutinin__InfluenzaA__AHC62590

SEQ ID NO: 163456 - RNA, 1701 nt, Artificial Sequence; identical to SEQ ID NO: 159502
  derived and/or modified sequence opt4 from hemagglutinin__InfluenzaA__AHC62602

SEQ ID NO: 163457 - RNA, 1701 nt, Artificial Sequence
  derived and/or modified sequence opt4 from hemagglutinin__InfluenzaA__AHC62614
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagaucaucgacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163458 - RNA, 1701 nt, Artificial Sequence; identical to SEQ ID NO: 163138
  derived and/or modified sequence opt4 from hemagglutinin__InfluenzaA__AHC62626

SEQ ID NO: 163459 - RNA, 1701 nt, Artificial Sequence; identical to SEQ ID NO: 159502
  derived and/or modified sequence opt4 from hemagglutinin__InfluenzaA__AHC62638

SEQ ID NO: 163460 - RNA, 1701 nt, Artificial Sequence; identical to SEQ ID NO: 163302
  derived and/or modified sequence opt4 from hemagglutinin__InfluenzaA__AHC62650

SEQ ID NO: 163461 - RNA, 1701 nt, Artificial Sequence
  derived and/or modified sequence opt4 from hemagglutinin__InfluenzaA__AHC62662
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcagcugcuaccccuacgacgugcccgacuacgccagccugagaagccugguggccagcagcggcacccuggaguucaacaacgagagcuucaacuggaccggcgugacccagaacggcaccagcagcgccugcaucagaggcagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163462 - RNA, 1701 nt, Artificial Sequence
  derived and/or modified sequence opt4 from hemagglutinin__InfluenzaA__AHC62674
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugaucgccagcagcggcacccuggaguucaacaacgagagcuucaacuggaccggcgugacccagaacggcaccagcagcgccugcaucagaggcagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacaccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163463 - RNA, 1701 nt, Artificial Sequence; identical to SEQ ID NO: 162580
  derived and/or modified sequence opt4 from hemagglutinin__InfluenzaA__AHE37972

SEQ ID NO: 163464 - RNA, 1701 nt, Artificial Sequence
  derived and/or modified sequence opt4 from hemagglutinin__InfluenzaA__AHE37973
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcaccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaucaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163465 - RNA, 1701 nt, Artificial Sequence
  derived and/or modified sequence opt4 from hemagglutinin__InfluenzaA__AHE37974
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163466 - RNA, 1701 nt, Artificial Sequence; identical to SEQ ID NO: 162560
  derived and/or modified sequence opt4 from hemagglutinin__InfluenzaA__AHE37975

SEQ ID NO: 163467 - RNA, 1701 nt, Artificial Sequence
  derived and/or modified sequence opt4 from hemagglutinin__InfluenzaA__AHE37976
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcgccgccagcagcuggagcuacaucguggagaccagcagcagcaacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggagauccuggugcuguggggcauccaccaccccagcaccaccaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagaggcaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163468 - RNA, 1701 nt, Artificial Sequence; identical to SEQ ID NO: 162560
  derived and/or modified sequence opt4 from hemagglutinin__InfluenzaA__AHE37977

SEQ ID NO: 163469 - RNA, 1701 nt, Artificial Sequence; identical to SEQ ID NO: 162580
  derived and/or modified sequence opt4 from hemagglutinin__InfluenzaA__AHE37978

SEQ ID NO: 163470 - RNA, 1701 nt, Artificial Sequence; identical to SEQ ID NO: 162560
  derived and/or modified sequence opt4 from hemagglutinin__InfluenzaA__AHE37979

SEQ ID NO: 163471 - RNA, 1701 nt, Artificial Sequence
  derived and/or modified sequence opt4 from hemagglutinin__InfluenzaA__AHE37980
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcgugaccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163472 - RNA, 1701 nt, Artificial Sequence
  derived and/or modified sequence opt4 from hemagglutinin__InfluenzaA__AHE37981
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacauccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163473 - RNA, 1701 nt, Artificial Sequence; identical to SEQ ID NO: 162560
  derived and/or modified sequence opt4 from hemagglutinin__InfluenzaA__AHE37982

SEQ ID NO: 163474 - RNA, 1701 nt, Artificial Sequence
  derived and/or modified sequence opt4 from hemagglutinin__InfluenzaA__AHE37983
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcgagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163475 - RNA, 1701 nt, Artificial Sequence
  derived and/or modified sequence opt4 from hemagglutinin__InfluenzaA__AHE37984
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163476 - RNA, 1701 nt, Artificial Sequence
  derived and/or modified sequence opt4 from hemagglutinin__InfluenzaA__AHE37985
augaagaccaucaucgcccugagcuacauccugugccugguguucgcccaggagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugaagagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163477 - RNA, 1701 nt, Artificial Sequence; identical to SEQ ID NO: 162442
  derived and/or modified sequence opt4 from hemagglutinin__InfluenzaA__AHE37986

SEQ ID NO: 163478 - RNA, 1701 nt, Artificial Sequence; identical to SEQ ID NO: 162378
  derived and/or modified sequence opt4 from hemagglutinin__InfluenzaA__AHE37987

SEQ ID NO: 163479 - RNA, 1701 nt, Artificial Sequence
  derived and/or modified sequence opt4 from hemagglutinin__InfluenzaA__AHE37988
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccagaaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163480 - RNA, 1701 nt, Artificial Sequence; identical to SEQ ID NO: 162514
  derived and/or modified sequence opt4 from hemagglutinin__InfluenzaA__AHE37989

SEQ ID NO: 163481 - RNA, 1701 nt, Artificial Sequence; identical to SEQ ID NO: 162378
  derived and/or modified sequence opt4 from hemagglutinin__InfluenzaA__AHE37990

SEQ ID NO: 163482 - RNA, 1701 nt, Artificial Sequence; identical to SEQ ID NO: 162378
  derived and/or modified sequence opt4 from hemagglutinin__InfluenzaA__AHE37991

SEQ ID NO: 163483 - RNA, 1701 nt, Artificial Sequence
  derived and/or modified sequence opt4 from hemagglutinin__InfluenzaA__AHE37992
augaagaccaucaucgcccugagcuacauccugugccugguguucgcccaggagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucgacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163484 - RNA, 1701 nt, Artificial Sequence; identical to SEQ ID NO: 162560
  derived and/or modified sequence opt4 from hemagglutinin__InfluenzaA__AHE38023

SEQ ID NO: 163485 - RNA, 1701 nt, Artificial Sequence
  derived and/or modified sequence opt4 from hemagglutinin__InfluenzaA__AHE38024
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaccagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163486 - RNA, 1701 nt, Artificial Sequence
  derived and/or modified sequence opt4 from hemagglutinin__InfluenzaA__AHE38026
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgagaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163487 - RNA, 1701 nt, Artificial Sequence; identical to SEQ ID NO: 162403
  derived and/or modified sequence opt4 from hemagglutinin__InfluenzaA__AHE38027

SEQ ID NO: 163488 - RNA, 1683 nt, Artificial Sequence
  derived and/or modified sequence opt4 from hemagglutinin__InfluenzaA__AHF20558
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgccaccagcgccugcagaagaagcggcagcagcuucuacgccgagaugaaguggcugcugagcaacaccgacaacgccgccuucccccagaugaccaagagcuacaagaacaccagaaagagccccgcccugaucguguggggcauccaccacagcgugagcaccgccgagcagaccaagcuguacggcagcggcaacaagcuggugaccgugggcagcagcaacuaccagcagagcuucgugcccagccccggcgccagaccccaggugaacggccugagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagagccgugggcaagugccccagauacgugaagcagagaagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaacgagguggagaagcagaucggcaacgugaucaacuggaccagagacagcaucaccgagguguggagcuacaacgccgagcugcugguggccauggagaaccagcacaccaucgaccuggccgacagcgagauggacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgugaugggccugguguucaucugcgugcagaacggcaacaugagaugcaccaucggcaucuga

SEQ ID NO: 163489 - RNA, 1683 nt, Artificial Sequence
  derived and/or modified sequence opt4 from hemagglutinin__InfluenzaA__AHF20568
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgccaccagcgccugcagaagaagcggcagcagcuucuacgccgagaugaaguggcugcugagcaacaccgacaacgccgccuucccccagaugaccaagagcuacaagaacaccagaaagagccccgcccugaucguguggggcauccaccacagcgugagcaccgccgagcagaccaagcuguacggcagcggcaacaagcuggugaccgugggcagcagcaacuaccagcagagcuucgugcccagccccggcgccagaccccaggugaacggccugagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaugagcaaccugcccuuccagaacaucgacagcagagccgugggcaagugccccagauacgugaagcagagaagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaacgagguggagaagcagaucggcaacgugaucaacuggaccagagacagcaucaccgagguguggagcuacaacgccgagcugcugguggccauggagaaccagcacaccaucgaccuggccgacagcgagauggacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgugaugggccugguguucaucugcgugaagaacggcaacaugagaugcaccaucugcaucuga

SEQ ID NO: 163490 - RNA, 1698 nt, Artificial Sequence; identical to SEQ ID NO: 160313
  derived and/or modified sequence opt4 from hemagglutinin__InfluenzaA__AHG96108

SEQ ID NO: 163491 - RNA, 1698 nt, Artificial Sequence; identical to SEQ ID NO: 160313
  derived and/or modified sequence opt4 from hemagglutinin__InfluenzaA__AHG96120

SEQ ID NO: 163492 - RNA, 1698 nt, Artificial Sequence; identical to SEQ ID NO: 160313
  derived and/or modified sequence opt4 from hemagglutinin__InfluenzaA__AHG96132

SEQ ID NO: 163493 - RNA, 1698 nt, Artificial Sequence
  derived and/or modified sequence opt4 from hemagglutinin__InfluenzaA__AHG96144
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgugcagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 163494 - RNA, 1698 nt, Artificial Sequence; identical to SEQ ID NO: 160313
  derived and/or modified sequence opt4 from hemagglutinin__InfluenzaA__AHG96156

SEQ ID NO: 163495 - RNA, 1698 nt, Artificial Sequence; identical to SEQ ID NO: 160313
  derived and/or modified sequence opt4 from hemagglutinin__InfluenzaA__AHG96168

SEQ ID NO: 163496 - RNA, 1698 nt, Artificial Sequence; identical to SEQ ID NO: 160313
  derived and/or modified sequence opt4 from hemagglutinin__InfluenzaA__AHG96180

SEQ ID NO: 163497 - RNA, 1698 nt, Artificial Sequence; identical to SEQ ID NO: 160313
  derived and/or modified sequence opt4 from hemagglutinin__InfluenzaA__AHG96192

SEQ ID NO: 163498 - RNA, 1698 nt, Artificial Sequence; identical to SEQ ID NO: 160313
  derived and/or modified sequence opt4 from hemagglutinin__InfluenzaA__AHG96204

SEQ ID NO: 163499 - RNA, 1698 nt, Artificial Sequence; identical to SEQ ID NO: 160313
  derived and/or modified sequence opt4 from hemagglutinin__InfluenzaA__AHG96216

SEQ ID NO: 163500 - RNA, 1698 nt, Artificial Sequence; identical to SEQ ID NO: 160313
  derived and/or modified sequence opt4 from hemagglutinin__InfluenzaA__AHG96228

SEQ ID NO: 163501 - RNA, 1698 nt, Artificial Sequence; identical to SEQ ID NO: 163493
  derived and/or modified sequence opt4 from hemagglutinin__InfluenzaA__AHG96240

SEQ ID NO: 163502 - RNA, 1698 nt, Artificial Sequence; identical to SEQ ID NO: 160313
  derived and/or modified sequence opt4 from hemagglutinin__InfluenzaA__AHG96252

SEQ ID NO: 163503 - RNA, 1698 nt, Artificial Sequence; identical to SEQ ID NO: 160313
  derived and/or modified sequence opt4 from hemagglutinin__InfluenzaA__AHG96264

SEQ ID NO: 163504 - RNA, 1698 nt, Artificial Sequence; identical to SEQ ID NO: 160313
  derived and/or modified sequence opt4 from hemagglutinin__InfluenzaA__AHG96276

SEQ ID NO: 163505 - RNA, 1698 nt, Artificial Sequence; identical to SEQ ID NO: 160313
  derived and/or modified sequence opt4 from hemagglutinin__InfluenzaA__AHG96288

SEQ ID NO: 163506 - RNA, 1698 nt, Artificial Sequence; identical to SEQ ID NO: 160313
  derived and/or modified sequence opt4 from hemagglutinin__InfluenzaA__AHG96300

SEQ ID NO: 163507 - RNA, 1701 nt, Artificial Sequence
  derived and/or modified sequence opt4 from hemagglutinin__InfluenzaA__AHG96312
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggugccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163508 - RNA, 1701 nt, Artificial Sequence; identical to SEQ ID NO: 162560
  derived and/or modified sequence opt4 from hemagglutinin__InfluenzaA__AHG96313

SEQ ID NO: 163509 - RNA, 1701 nt, Artificial Sequence
  derived and/or modified sequence opt4 from hemagglutinin__InfluenzaA__AHG96314
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguacaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163510 - RNA, 1701 nt, Artificial Sequence; identical to SEQ ID NO: 162560
  derived and/or modified sequence opt4 from hemagglutinin__InfluenzaA__AHG96315

SEQ ID NO: 163511 - RNA, 1701 nt, Artificial Sequence; identical to SEQ ID NO: 162560
  derived and/or modified sequence opt4 from hemagglutinin__InfluenzaA__AHG96316

SEQ ID NO: 163512 - RNA, 1701 nt, Artificial Sequence; identical to SEQ ID NO: 162560
  derived and/or modified sequence opt4 from hemagglutinin__InfluenzaA__AHG96317

SEQ ID NO: 163513 - RNA, 1701 nt, Artificial Sequence; identical to SEQ ID NO: 162560
  derived and/or modified sequence opt4 from hemagglutinin__InfluenzaA__AHG96320

SEQ ID NO: 163514 - RNA, 1701 nt, Artificial Sequence; identical to SEQ ID NO: 162560
  derived and/or modified sequence opt4 from hemagglutinin__InfluenzaA__AHG96321

SEQ ID NO: 163515 - RNA, 1701 nt, Artificial Sequence; identical to SEQ ID NO: 162560
  derived and/or modified sequence opt4 from hemagglutinin__InfluenzaA__AHG96322

SEQ ID NO: 163516 - RNA, 1701 nt, Artificial Sequence; identical to SEQ ID NO: 162560
  derived and/or modified sequence opt4 from hemagglutinin__InfluenzaA__AHG96324

SEQ ID NO: 163517 - RNA, 1701 nt, Artificial Sequence; identical to SEQ ID NO: 162560
  derived and/or modified sequence opt4 from hemagglutinin__InfluenzaA__AHG96325

SEQ ID NO: 163518 - RNA, 1701 nt, Artificial Sequence
  derived and/or modified sequence opt4 from hemagglutinin__InfluenzaA__AHG96326
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163519 - RNA, 1701 nt, Artificial Sequence; identical to SEQ ID NO: 162560
  derived and/or modified sequence opt4 from hemagglutinin__InfluenzaA__AHG96327

SEQ ID NO: 163520 - RNA, 1701 nt, Artificial Sequence
  derived and/or modified sequence opt4 from hemagglutinin__InfluenzaA__AHG96329
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaagaucagaaaccagcugaagaacaacgccaaggagaucggcaacggcugcuucgaguucuaccacaagugcgacaacaccugcauggagagcgugaagaacggcaccuacgaguaccccaaguacagcgaggaggccaagcugaacagagagaagaucgacggcgugaagcuggagagcaccaagaucuaccagauccuggccaucuacagcaccguggccagcagccuggugcugguggugagccugggcgccaucagcuucuggaugugcagcaacggcagccugcagugcagaaucugcaucuga

SEQ ID NO: 163521 - RNA, 1701 nt, Artificial Sequence
  derived and/or modified sequence opt4 from hemagglutinin__InfluenzaA__AHG96330
augaaggccauccugguggugcugcuguacaccuucgccaccgccaccgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagccuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaagaucagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163522 - RNA, 1701 nt, Artificial Sequence; identical to SEQ ID NO: 162560
  derived and/or modified sequence opt4 from hemagglutinin__InfluenzaA__AHG96332

SEQ ID NO: 163523 - RNA, 1701 nt, Artificial Sequence
  derived and/or modified sequence opt4 from hemagglutinin__InfluenzaA__AHG96334
augaaggccauccugguggugcugcuguacacccuggccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163524 - RNA, 1701 nt, Artificial Sequence
  derived and/or modified sequence opt4 from hemagglutinin__InfluenzaA__AHG96335
augaaggccauccugguggugcugcuguacaccuucgagaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugaagggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163525 - RNA, 1701 nt, Artificial Sequence
  derived and/or modified sequence opt4 from hemagglutinin__InfluenzaA__AHG96336
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugagagacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163526 - RNA, 1701 nt, Artificial Sequence
  derived and/or modified sequence opt4 from hemagglutinin__InfluenzaA__AHG96338
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcagccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163527 - RNA, 1701 nt, Artificial Sequence
  derived and/or modified sequence opt4 from hemagglutinin__InfluenzaA__AHG96339
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggagauccuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163528 - RNA, 1701 nt, Artificial Sequence; identical to SEQ ID NO: 162560
  derived and/or modified sequence opt4 from hemagglutinin__InfluenzaA__AHG96340

SEQ ID NO: 163529 - RNA, 1701 nt, Artificial Sequence
  derived and/or modified sequence opt4 from hemagglutinin__InfluenzaA__AHG96341
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163530 - RNA, 1701 nt, Artificial Sequence
  derived and/or modified sequence opt4 from hemagglutinin__InfluenzaA__AHG96342
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaugugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163531 - RNA, 1701 nt, Artificial Sequence
  derived and/or modified sequence opt4 from hemagglutinin__InfluenzaA__AHG96343
augaaggccauccugguggugcugcuguacaccuucgccaccgccaccgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163532 - RNA, 1701 nt, Artificial Sequence; identical to SEQ ID NO: 162560
  derived and/or modified sequence opt4 from hemagglutinin__InfluenzaA__AHG96344

SEQ ID NO: 163533 - RNA, 1701 nt, Artificial Sequence; identical to SEQ ID NO: 163523
  derived and/or modified sequence opt4 from hemagglutinin__InfluenzaA__AHG96345

SEQ ID NO: 163534 - RNA, 1701 nt, Artificial Sequence; identical to SEQ ID NO: 162560
  derived and/or modified sequence opt4 from hemagglutinin__InfluenzaA__AHG96346

SEQ ID NO: 163535 - RNA, 1701 nt, Artificial Sequence; identical to SEQ ID NO: 162560
  derived and/or modified sequence opt4 from hemagglutinin__InfluenzaA__AHG96347

SEQ ID NO: 163536 - RNA, 1701 nt, Artificial Sequence; identical to SEQ ID NO: 162560
  derived and/or modified sequence opt4 from hemagglutinin__InfluenzaA__AHG96348

SEQ ID NO: 163537 - RNA, 1701 nt, Artificial Sequence; identical to SEQ ID NO: 162560
  derived and/or modified sequence opt4 from hemagglutinin__InfluenzaA__AHG96349

SEQ ID NO: 163538 - RNA, 1701 nt, Artificial Sequence; identical to SEQ ID NO: 162560
  derived and/or modified sequence opt4 from hemagglutinin__InfluenzaA__AHG96350

SEQ ID NO: 163539 - RNA, 1701 nt, Artificial Sequence; identical to SEQ ID NO: 162560
  derived and/or modified sequence opt4 from hemagglutinin__InfluenzaA__AHG96351

SEQ ID NO: 163540 - RNA, 1701 nt, Artificial Sequence; identical to SEQ ID NO: 162560
  derived and/or modified sequence opt4 from hemagglutinin__InfluenzaA__AHG96352

SEQ ID NO: 163541 - RNA, 1701 nt, Artificial Sequence
  derived and/or modified sequence opt4 from hemagglutinin__InfluenzaA__AHG96353
augaaggccauccugguggugcugcuguacaccuucgccaccaccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163542 - RNA, 1701 nt, Artificial Sequence; identical to SEQ ID NO: 162560
  derived and/or modified sequence opt4 from hemagglutinin__InfluenzaA__AHG96354

SEQ ID NO: 163543 - RNA, 1701 nt, Artificial Sequence
  derived and/or modified sequence opt4 from hemagglutinin__InfluenzaA__AHG96355
augaaggccauccugguggugcugcuguacacccuggccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccagcuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163544 - RNA, 1701 nt, Artificial Sequence; identical to SEQ ID NO: 162378
  derived and/or modified sequence opt4 from hemagglutinin__InfluenzaA__AHG96356

SEQ ID NO: 163545 - RNA, 1701 nt, Artificial Sequence
  derived and/or modified sequence opt4 from hemagglutinin__InfluenzaA__AHG96359
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacuggaccggcgugacccagaacggcaccagcagcagcugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccgugaccgacaacgaccagaucuuccuguacgcccaggccagcggcagaaucaccgugagcaccaagagaagccagcagaccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163546 - RNA, 1701 nt, Artificial Sequence; identical to SEQ ID NO: 163545
  derived and/or modified sequence opt4 from hemagglutinin__InfluenzaA__AHG96371

SEQ ID NO: 163547 - RNA, 1701 nt, Artificial Sequence; identical to SEQ ID NO: 163545
  derived and/or modified sequence opt4 from hemagglutinin__InfluenzaA__AHG96383

SEQ ID NO: 163548 - RNA, 1698 nt, Artificial Sequence; identical to SEQ ID NO: 160313
  derived and/or modified sequence opt4 from hemagglutinin__InfluenzaA__AHG96395

SEQ ID NO: 163549 - RNA, 1701 nt, Artificial Sequence; identical to SEQ ID NO: 163545
  derived and/or modified sequence opt4 from hemagglutinin__InfluenzaA__AHG96407

SEQ ID NO: 163550 - RNA, 1701 nt, Artificial Sequence; identical to SEQ ID NO: 163545
  derived and/or modified sequence opt4 from hemagglutinin__InfluenzaA__AHG96419

SEQ ID NO: 163551 - RNA, 1701 nt, Artificial Sequence; identical to SEQ ID NO: 163545
  derived and/or modified sequence opt4 from hemagglutinin__InfluenzaA__AHG96431

SEQ ID NO: 163552 - RNA, 1701 nt, Artificial Sequence; identical to SEQ ID NO: 163545
  derived and/or modified sequence opt4 from hemagglutinin__InfluenzaA__AHG96443

SEQ ID NO: 163553 - RNA, 1701 nt, Artificial Sequence; identical to SEQ ID NO: 163545
  derived and/or modified sequence opt4 from hemagglutinin__InfluenzaA__AHG96455

SEQ ID NO: 163554 - RNA, 1701 nt, Artificial Sequence; identical to SEQ ID NO: 163545
  derived and/or modified sequence opt4 from hemagglutinin__InfluenzaA__AHG96467

SEQ ID NO: 163555 - RNA, 1701 nt, Artificial Sequence; identical to SEQ ID NO: 163545
  derived and/or modified sequence opt4 from hemagglutinin__InfluenzaA__AHG96479

SEQ ID NO: 163556 - RNA, 1701 nt, Artificial Sequence; identical to SEQ ID NO: 163545
  derived and/or modified sequence opt4 from hemagglutinin__InfluenzaA__AHG96491

SEQ ID NO: 163557 - RNA, 1701 nt, Artificial Sequence; identical to SEQ ID NO: 154876
  derived and/or modified sequence opt4 from hemagglutinin__InfluenzaA__AHG96503

SEQ ID NO: 163558 - RNA, 1698 nt, Artificial Sequence; identical to SEQ ID NO: 160313
  derived and/or modified sequence opt4 from hemagglutinin__InfluenzaA__AHG96515

SEQ ID NO: 163559 - RNA, 1698 nt, Artificial Sequence; identical to SEQ ID NO: 160313
  derived and/or modified sequence opt4 from hemagglutinin__InfluenzaA__AHG96527

SEQ ID NO: 163560 - RNA, 1698 nt, Artificial Sequence; identical to SEQ ID NO: 160313
  derived and/or modified sequence opt4 from hemagglutinin__InfluenzaA__AHG96539

SEQ ID NO: 163561 - RNA, 1698 nt, Artificial Sequence; identical to SEQ ID NO: 160313
  derived and/or modified sequence opt4 from hemagglutinin__InfluenzaA__AHG96551

SEQ ID NO: 163562 - RNA, 1698 nt, Artificial Sequence; identical to SEQ ID NO: 163493
  derived and/or modified sequence opt4 from hemagglutinin__InfluenzaA__AHG96563

SEQ ID NO: 163563 - RNA, 1698 nt, Artificial Sequence; identical to SEQ ID NO: 160313
  derived and/or modified sequence opt4 from hemagglutinin__InfluenzaA__AHG96575

SEQ ID NO: 163564 - RNA, 1698 nt, Artificial Sequence; identical to SEQ ID NO: 160313
  derived and/or modified sequence opt4 from hemagglutinin__InfluenzaA__AHG96587

SEQ ID NO: 163565 - RNA, 1698 nt, Artificial Sequence; identical to SEQ ID NO: 160313
  derived and/or modified sequence opt4 from hemagglutinin__InfluenzaA__AHG96599

SEQ ID NO: 163566 - RNA, 1698 nt, Artificial Sequence; identical to SEQ ID NO: 160313
  derived and/or modified sequence opt4 from hemagglutinin__InfluenzaA__AHG96611

SEQ ID NO: 163567 - RNA, 1698 nt, Artificial Sequence; identical to SEQ ID NO: 160313
  derived and/or modified sequence opt4 from hemagglutinin__InfluenzaA__AHG96623

SEQ ID NO: 163568 - RNA, 1698 nt, Artificial Sequence; identical to SEQ ID NO: 160313
  derived and/or modified sequence opt4 from hemagglutinin__InfluenzaA__AHG96635

SEQ ID NO: 163569 - RNA, 1698 nt, Artificial Sequence; identical to SEQ ID NO: 160313
  derived and/or modified sequence opt4 from hemagglutinin__InfluenzaA__AHG96647

SEQ ID NO: 163570 - RNA, 1698 nt, Artificial Sequence; identical to SEQ ID NO: 160313
  derived and/or modified sequence opt4 from hemagglutinin__InfluenzaA__AHG96659

SEQ ID NO: 163571 - RNA, 1698 nt, Artificial Sequence; identical to SEQ ID NO: 160313
  derived and/or modified sequence opt4 from hemagglutinin__InfluenzaA__AHG96671

SEQ ID NO: 163572 - RNA, 1698 nt, Artificial Sequence; identical to SEQ ID NO: 160313
  derived and/or modified sequence opt4 from hemagglutinin__InfluenzaA__AHG96683

SEQ ID NO: 163573 - RNA, 1701 nt, Artificial Sequence; identical to SEQ ID NO: 163545
  derived and/or modified sequence opt4 from hemagglutinin__InfluenzaA__AHG96695

SEQ ID NO: 163574 - RNA, 1701 nt, Artificial Sequence; identical to SEQ ID NO: 163545
  derived and/or modified sequence opt4 from hemagglutinin__InfluenzaA__AHG96707

SEQ ID NO: 163575 - RNA, 1701 nt, Artificial Sequence; identical to SEQ ID NO: 163545
  derived and/or modified sequence opt4 from hemagglutinin__InfluenzaA__AHG96719

SEQ ID NO: 163576 - RNA, 1701 nt, Artificial Sequence; identical to SEQ ID NO: 163545
  derived and/or modified sequence opt4 from hemagglutinin__InfluenzaA__AHG96731

SEQ ID NO: 163577 - RNA, 1701 nt, Artificial Sequence; identical to SEQ ID NO: 163545
  derived and/or modified sequence opt4 from hemagglutinin__InfluenzaA__AHG96743

SEQ ID NO: 163578 - RNA, 1701 nt, Artificial Sequence; identical to SEQ ID NO: 163545
  derived and/or modified sequence opt4 from hemagglutinin__InfluenzaA__AHG96755

SEQ ID NO: 163579 - RNA, 1701 nt, Artificial Sequence; identical to SEQ ID NO: 163545
  derived and/or modified sequence opt4 from hemagglutinin__InfluenzaA__AHG96767

SEQ ID NO: 163580 - RNA, 1701 nt, Artificial Sequence; identical to SEQ ID NO: 163545
  derived and/or modified sequence opt4 from hemagglutinin__InfluenzaA__AHG96779

SEQ ID NO: 163581 - RNA, 1701 nt, Artificial Sequence
  derived and/or modified sequence opt4 from hemagglutinin__InfluenzaA__AHG96791
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacuggaccggcgugacccagaacggcaccagcagcagcugcaagagaagaagcaacaacagcuucuucagcagacugaacuggcugacccagcugaaguucaaguaccccgcccugaacgugaccaugcccaacaacgagaaguucgacaagcuguacaucuggggcgugcaccaccccgugaccgacaacgaccagaucuuccuguacgcccaggccagcggcagaaucaccgugagcaccaagagaagccagcagaccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagagaagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163582 - RNA, 1701 nt, Artificial Sequence; identical to SEQ ID NO: 163545
  derived and/or modified sequence opt4 from hemagglutinin__InfluenzaA__AHG96803

SEQ ID NO: 163583 - RNA, 1701 nt, Artificial Sequence; identical to SEQ ID NO: 163545
  derived and/or modified sequence opt4 from hemagglutinin__InfluenzaA__AHG96815

SEQ ID NO: 163584 - RNA, 1701 nt, Artificial Sequence; identical to SEQ ID NO: 163545
  derived and/or modified sequence opt4 from hemagglutinin__InfluenzaA__AHG96827

SEQ ID NO: 163585 - RNA, 1701 nt, Artificial Sequence; identical to SEQ ID NO: 163545
  derived and/or modified sequence opt4 from hemagglutinin__InfluenzaA__AHG96839

SEQ ID NO: 163586 - RNA, 1701 nt, Artificial Sequence; identical to SEQ ID NO: 163545
  derived and/or modified sequence opt4 from hemagglutinin__InfluenzaA__AHG96851

SEQ ID NO: 163587 - RNA, 1701 nt, Artificial Sequence; identical to SEQ ID NO: 163545
  derived and/or modified sequence opt4 from hemagglutinin__InfluenzaA__AHG96863

SEQ ID NO: 163588 - RNA, 1701 nt, Artificial Sequence; identical to SEQ ID NO: 163545
  derived and/or modified sequence opt4 from hemagglutinin__InfluenzaA__AHG96875

SEQ ID NO: 163589 - RNA, 1701 nt, Artificial Sequence; identical to SEQ ID NO: 163545
  derived and/or modified sequence opt4 from hemagglutinin__InfluenzaA__AHG96887

SEQ ID NO: 163590 - RNA, 1701 nt, Artificial Sequence; identical to SEQ ID NO: 163545
  derived and/or modified sequence opt4 from hemagglutinin__InfluenzaA__AHG96899

SEQ ID NO: 163591 - RNA, 1701 nt, Artificial Sequence; identical to SEQ ID NO: 163545
  derived and/or modified sequence opt4 from hemagglutinin__InfluenzaA__AHG96911

SEQ ID NO: 163592 - RNA, 1701 nt, Artificial Sequence; identical to SEQ ID NO: 163545
  derived and/or modified sequence opt4 from hemagglutinin__InfluenzaA__AHG96923

SEQ ID NO: 163593 - RNA, 1701 nt, Artificial Sequence; identical to SEQ ID NO: 163545
  derived and/or modified sequence opt4 from hemagglutinin__InfluenzaA__AHG96935

SEQ ID NO: 163594 - RNA, 1701 nt, Artificial Sequence; identical to SEQ ID NO: 163545
  derived and/or modified sequence opt4 from hemagglutinin__InfluenzaA__AHG96947

SEQ ID NO: 163595 - RNA, 1701 nt, Artificial Sequence; identical to SEQ ID NO: 163545
  derived and/or modified sequence opt4 from hemagglutinin__InfluenzaA__AHG96959

SEQ ID NO: 163596 - RNA, 1701 nt, Artificial Sequence; identical to SEQ ID NO: 163545
  derived and/or modified sequence opt4 from hemagglutinin__InfluenzaA__AHG96971

SEQ ID NO: 163597 - RNA, 1701 nt, Artificial Sequence; identical to SEQ ID NO: 163545
  derived and/or modified sequence opt4 from hemagglutinin__InfluenzaA__AHG96983

SEQ ID NO: 163598 - RNA, 1701 nt, Artificial Sequence; identical to SEQ ID NO: 163545
  derived and/or modified sequence opt4 from hemagglutinin__InfluenzaA__AHG96995

SEQ ID NO: 163599 - RNA, 1701 nt, Artificial Sequence; identical to SEQ ID NO: 163545
  derived and/or modified sequence opt4 from hemagglutinin__InfluenzaA__AHG97007

SEQ ID NO: 163600 - RNA, 1701 nt, Artificial Sequence; identical to SEQ ID NO: 163545
  derived and/or modified sequence opt4 from hemagglutinin__InfluenzaA__AHG97019

SEQ ID NO: 163601 - RNA, 1701 nt, Artificial Sequence; identical to SEQ ID NO: 163545
  derived and/or modified sequence opt4 from hemagglutinin__InfluenzaA__AHG97031

SEQ ID NO: 163602 - RNA, 1701 nt, Artificial Sequence; identical to SEQ ID NO: 163545
  derived and/or modified sequence opt4 from hemagglutinin__InfluenzaA__AHG97043

SEQ ID NO: 163603 - RNA, 1701 nt, Artificial Sequence
  derived and/or modified sequence opt4 from hemagglutinin__InfluenzaA__AHH00866
augaagaccaucaucgcccugagcuacauccugugccuggccuucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcuggagaacagauaccccgcccugaacgugaccaugcccaacaacgacaaguucgacaagcuguacaucuggggcgugcaccaccccagcaccgacagcgaccagaucagcguguacgcccaggccagcggcagagugaccgugagcaccaagagaagccagcagaccgugauccccaacaucggcagcagacccugggugagaggcaucagcagcagaaucagcaucuacuggaccaucgugaaccccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacaagcugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 163604 - RNA, 1701 nt, Artificial Sequence
  derived and/or modified sequence opt4 from hemagglutinin__InfluenzaA__AHH00870
augaagaccaucaucgcccugagcuacauccugugccuggccuucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcuggagaacagauaccccgcccugaacgugaccaugcccaacaacgacaaguucgacaagcuguacaucuggggcgugcaccaccccagcaccgacagcgaccagaucagcguguacgcccaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacaagcugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 163605 - RNA, 1701 nt, Artificial Sequence
  derived and/or modified sequence opt4 from hemagglutinin__InfluenzaA__AHJ57430
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcagacugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucagccccaagaccagcagcuggcccaaccacgacagcaacaagggcgugagagccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccgccagcggcaucaucaucagcgacacccccgugcacgacugcaacaccaccugccagacccccaagggcgccgugaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcaacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163606 - RNA, 1701 nt, Artificial Sequence
  derived and/or modified sequence opt4 from hemagglutinin__InfluenzaA__AHJ57431
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugagagccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163607 - RNA, 1701 nt, Artificial Sequence
  derived and/or modified sequence opt4 from hemagglutinin__InfluenzaA__AHJ57432
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagccccagaucgccaucagacccaaggugagagaccaggagggcagaaugaacuacuacuggacccugguggagcccggcgacaagaucaccuucgaggccaccggcaaccugguggugcccagauacgccuucgcccuggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggagggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163608 - RNA, 1701 nt, Artificial Sequence
  derived and/or modified sequence opt4 from hemagglutinin__InfluenzaA__AHJ57433
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaaggagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163609 - RNA, 1701 nt, Artificial Sequence
  derived and/or modified sequence opt4 from hemagglutinin__InfluenzaA__AHJ57434
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacccccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaaggagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163610 - RNA, 1701 nt, Artificial Sequence
  derived and/or modified sequence opt4 from hemagglutinin__InfluenzaA__AHJ57435
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacagaggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163611 - RNA, 1701 nt, Artificial Sequence
  derived and/or modified sequence opt4 from hemagglutinin__InfluenzaA__AHJ57436
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccauccccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagcugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163612 - RNA, 1701 nt, Artificial Sequence
  derived and/or modified sequence opt4 from hemagglutinin__InfluenzaA__AHJ57437
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugaaggagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163613 - RNA, 1701 nt, Artificial Sequence
  derived and/or modified sequence opt4 from hemagglutinin__InfluenzaA__AHJ57438
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaaguggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgacugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaccggcagcaucagaaacggcaccuacgaccacgacguguacagagacgaggcccugaacaacagauuccagaucaagggcguggaggugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163614 - RNA, 1701 nt, Artificial Sequence
  derived and/or modified sequence opt4 from hemagglutinin__InfluenzaA__AHJ57651
augaucgccuucaucgugaucgccauccuggccgccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcacccuggagggcuggauccugggcaaccccagaugcggcauccugcuggccgaccagagcuggagcuacaucguggagagacccaacgccagaaacggcaucugcuaccccggcacccugaacgagguggaggagcugaaggcccugaucggcagcggcgagagaguggagagauucgagauguuccccaagagcaccugggccggcguggacaccgacagcggcgugagcagcgccugcccccugggcaacggccccagcuucuacagaaaccugcuguggaucaucaagcugaagagcagcgaguaccccgugaucagaggcaccuucaacaacaccggcgacaagagcauccuguacuucuggggcgugcaccacccccccgugaccaccgagcaggaggcccuguacggcagcggcgacagauacgugagaaugggcaccgagagcaugaacuucgccagaagccccgagaucgccgccagacccgccgugaacggccagagaggcagaaucgacuacuucuggagcauccugaagcccggcgagacccugaacguggagagcaacggcaaccugaucgcccccugguacgccuacagauucgugaacaaggacagcaagggcgccaucuucagaagcacccugcccaucgagaacugcgacgccaccugccagaccaccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacagagagagcacccagaaggccaucgacggcaucaccaacaaggugaacagcaucaucgacaagaugaacacccaguucgaggccgugggccacgaguucagcaaccuggagagaagaaucgacaaccugaacaagagaauggaggacggcuuccuggacguguggaccuacaacgccgagcugcuggugcugcuggagaacgagagaacccuggacaugcacgacgccaacgugaagauccuguacgagaaggugagaagccagcugagagacaacgccaaggaccugggcaacggcugcuucgaguucuggcacaagugcgacaacgagugcaucgagagcgugaagaacggcaccuacaacuaccccaaguaccagagcgagagcagacugaacagacagaccaucgagagcgugaagcuggagaaccugggcguguaccagauccuggccaucuacagcaccgugagcagcagccuggugcuggugggccugauccuggccaugggccuguggaugugcagcaacggcagcaugcagugcagaaucugcaucuga

SEQ ID NO: 163615 - RNA, 1701 nt, Artificial Sequence
  derived and/or modified sequence opt4 from hemagglutinin__InfluenzaA__AHJ57663
augaucgccuucaucgugaucgccacccugguggccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcacccuggagggcuggauccugggcaaccccagaugcggcauccugcuggccgaccagagcuggagcuacaucguggagagacccaacgccagaaacggcaucugcuaccccggcacccugaacgaggccgaggagcugaaggcccugaucggcagcggcgagagaguggagagauucgagauguuccccaagagcaccuggaccggcguggacaccgagagcggcgugagcagcgccugcccccugggcaacggccccagcuucuacagaaaccugcuguggaucaucaagcugaagagcagcgaguaccccgugaucagaggcaccuucaacaacaccggcgacaagagcauccuguacuucuggggcgugcaccacccccccgugaccaccgagcagaacgcccuguacggcagcggcgacagauacgugagaaugggcaccgagagcaugaacuucgccagaagccccgagaucgccgccagacccgccgugaacggccagagaggcagaaucgacuacuucuggagcauccugaagcccggcgagacccugaacguggagagcaacggcaaccugaucgcccccugguacgccuacagauucgugaacaaggacagcaagggcgccaucuucagaagcaaccugcccaucgagaacugcgacgccaccugccagaccaccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacaaggagagcacccagaaggccaucgacggcaucaccaacaaggugaacagcaucaucgacaagaugaacacccaguucgaggccgugggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagagagugaagagccagcugagagacaacgccaacgaccugggcaacggcugcuucgaguucuggcacaagugcgacaacgagugcauggagagcgugaagaacggcaccuacaacuaccccaaguaccaggccgagagcagacugaacaagcagaagaucgagagcgugaagcuggaggaguucggcguguaccagauccuggccaucuacagcaccgugagcagcagccuggugcuggugggccugaucauggccaugggccuguggaugugccccaacggcagcaugcagugcagaaucugcaucuga

SEQ ID NO: 163616 - RNA, 1701 nt, Artificial Sequence
  derived and/or modified sequence opt4 from hemagglutinin__InfluenzaA__AHJ57674
augaucgccuucaucgugaucgccauccuggugaccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcacccuggagggcuggauccugggcaaccccagaugcggcauccugcuggccgaccagagcuggagcuacaucguggagagacccaacgccagaaacggcaucugcuaccccggcacccugaacgagguggaggagcugaaggcccugaucggcagcggcgagagaguggagagauucgagauguuccccaagagcaccugggccggcguggacaccaacagcggcgugagcagcgccugcccccugggcgagggccccagcuucuacagaaaccugcuguggaucaucaagcacaccaccagcggcuaccccgugaucaagggcaccuacagaaacaccggcgacaagagcgugcuguacuucuggggcgugcaccacccccccgacaccaccgagcagaacgugcuguacggcagcggcaacagauacgugagaaugggcaccgagagcaugaacuucgccagaagccccgagaucgccgccagacccgccgugaacggccagagaggcagaaucgacuacuucuggagcauccugaagcccggcgagacccugaacguggagagcaacggcaaccugaucgcccccugguacgccuacagauucgugaacaaggacagcaagggcgccaucuucagaagcaaccugcccaucgagaacugcgacgccaccugccagaccaccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacagagagagcacccagaaggccaucgacggcaucaccaacaaggugaacagcaucaucgacaagaugaacacccaguucgaggccgugggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagagagugagaagccagcugagagacaacgccaacgaccugggcaacggcugcuucgaguucuggcacaagugcgacaacgagugcauggagagcgugaagaacggcaccuacaacuaccccaaguaccaggccgagagcagacugaacagacagaagaucgagagcgugaagcuggaggaguucggcguguaccagauccuggccaucuacagcaccgugagcagcagccuggugcuggugggccugaucauggccaugggccuguggaugugcagcaacggcagcaugcagugcagaaucugcaucuga

SEQ ID NO: 163617 - RNA, 1701 nt, Artificial Sequence
  derived and/or modified sequence opt4 from hemagglutinin__InfluenzaA__AHJ57686
augaucgccuucaucgugaucgccauccuggccgccaccggcaagagcgacaagaucugcaucggcuaccacgccaacaacagcaccaccaagguggacaccauccuggagaagaacgugaccgugacccacagcguggagcugcuggagaaccagaaggagggcagauucugcaagaucagcaacaaggccccccuggaccugagagacugcacccuggagggcuggauccugggcaaccccagaugcggcauccugcuggccgaccagagcuggagcuacaucguggagagacccaacgccagaaacggcaucugcuaccccggcauccugaacgaggccgaggagcugaaggcccugaucggcagcggcgagagaguggagagauucgagauguuccccaagagcaccugggccggcguggacaccaacagcggcgugagcagcgccugcccccugggcaacggccccagcuucuacagaaaccugcuguggaucaucaagcugaagagcagcgccuaccccgugaucagaggcaccuucaacaacaccggcgacaagagcauccuguacuucuggggcgugcaccacccccccguggccaccgagcaggaggcccuguacggcagcggcaacagauacgugagaaugggcaccgagagcaugaacuucgccagaaaccccgagaucgccgccagacccgccgugaacggccagagaggcagaaucgacuacuucuggagcauccugaagcccggcgagacccugaacguggagagcaacggcaaccugaucgcccccugguacgccuacagauucgugaacaaggacagcaagggcgccaucuucagaagcaaccugcccaucgagaacugcgaggccaccugccagaccaccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacagagagagcacccagaaggccaucgacggcaucaccaacaaggugaacagcaucaucgacaagaugaacacccaguucgaggccgugggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagaaggugagaagccagcugagagacaacgccaacgaccugggcaacggcugcuucgaguucuggcacaagugcgacaacgagugcauggagagcgugaagaacggcaccuacgacuaccccaaguaccaggccgagagcagacugaacagacagaagaucgagagcgugaagcuggagaacuucgacguguaccagauccuggccaucuacagcaccgugagcagcagccuggugcuggugggccugaucauggccaugggccuguggaugugcagcaacggcagcaugcagugcagaaucugcaucuga

SEQ ID NO: 163618 - RNA, 1701 nt, Artificial Sequence
  derived and/or modified sequence opt4 from hemagglutinin__InfluenzaA__AHJ57697
augaucgccuucaucgugaucgccauccuggccgccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcacccuggagggcuggauccugggcaaccccagaugcggcauccugcuggccgaccagagcuggagcuacaucguggagagacccaacgccagaaacggcaucugcuaccccggcacccugaacgagguggaggagcugaaggcccugaucggcagcggcgagagaguggagagauucgagauguuccccaagagcaccugggccggcguggacaccaacagcggcgugagcagcgccugcccccugggcaacggccccagcuucuacagaaaccugcuguggaucaucaagcugaagagcagcgaguaccccgugaucagaggcaccuucaacaacaccggcgacaagagcauccuguacuucuggggcgugcaccacccccccgugaccaccgagcaggaggcccuguacggcagcggcgacagauacgugagaaugggcaccgagagcaugaacuucgccagaagccccgagaucgccgccagacccgccgugaacggccagagaggcagaaucgacuacuucuggagcauccugaagcccggcgagacccugaacguggagagcaacggcaaccugaucgcccccugguacgccuacagauucgugaacaaggacagcaagggcgccaucuucagaagcaaccugcccaucgagaacugcgacgccaccugccagaccaccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacagagagagcacccagaaggccaucgacggcaucaccaacaaggugaacagcaucaucgacaagaugaacacccaguucgaggccgugggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagaaggugaagagccagcugagagacaacgccaacgaccugggcaacggcugcuucgaguucuggcacaagugcgacaacgagugcauggagagcgugaagaacggcaccuacgacuaccccaaguaccaggccgagagcagacugaacagacagaagaucgagagcgugaagcuggagaacuucgacguguaccagauccuggccaucuacagcaccgugagcagcagccuggugcuggugggccugaucauggccaugggccuguggaugugcagcaacggcagcaugcagugcagaaucugcaucuga

SEQ ID NO: 163619 - RNA, 1701 nt, Artificial Sequence
  derived and/or modified sequence opt4 from hemagglutinin__InfluenzaA__AHJ57707
augaucgccuucaucgugaucgccauccuggugaccaccggcaagagcgacaagaucugcgugggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcacccuggagggcuggauccugggcaaccccagaugcggcauccugcuggccgaccagagcuggagcuacaucguggagagacccaacgccagaaacggcaucugcuaccccggcacccugaacgagguggaggagcugaaggcccugaucggcagcggcgagagaguggagagauucgagauguuccccaagagcaccuggaccggcguggacaccaacagcggcgugagcagcgccugcccccugggcgagggccccagcuucuacagaaaccugcuguggaucaucaagcacaccaccagcggcuaccccgugaucaagggcaccuacagaaacaccggcgacaagagcgugcuguacuucuggggcgugcaccacccccccgacaccaccgagcagaacgugcuguacggcagcggcaacagauacgugagaaugggcaccgagagcaugaacuucgccagaagccccgagaucgccgccagacccgccgugaacggccagagaggcagaaucgacuacuucuggagcauccugaagcccggcgagacccugaacguggagagcaacggcaaccugaucgcccccugguacgccuacagauucgugaacaaggacagcaagggcgccaucuucagaagcaaccugcccaucgagaacugcgacgccaccugccagaccaccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacagagagagcacccagaaggccaucgacggcaucaccaacaaggugaacagcaucaucgacaagaugaacacccaguucgaggccgugggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagagagugagaagccagcugagagacaacgccaacgaccugggcaacggcugcuucgaguucuggcacaagugcgacaacgagugcauggagagcgugaagaacggcaccuacaacuaccccaaguaccaggccgagagcagacugaacaagcagaagaucgagagcgugaagcuggaggaguucggcguguaccagauccuggccaucuacagcaccgugagcagcagccuggugcuggugggccugaucauggccaugggccuguggaugugcagcaacggcagcaugcagugcagaaucugcaucuga

SEQ ID NO: 163620 - RNA, 1701 nt, Artificial Sequence
  derived and/or modified sequence opt4 from hemagglutinin__InfluenzaA__AHJ57719
augaucgccuucaucgugaucgccauccuggccgccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcacccuggagggcuggauccugggcaaccccagaugcggcauccugcugagcgaccagagcuggagcuacaucguggagagacccaacgccagaaacggcaucugcuaccccggcauccugaacgaggccgaggagcugaaggcccugaucggcagcggcgagagaguggagagauucgagauguuccccaagagcaccugggccggcguggacaccaacagcggcgugagcagcgccugcccccugggcaacggccccagcuucuucagaaaccugcuguggaucaucaagcugaagagcagcaccuaccccgugaucagaggcaccuucaacaacaccggcgacaagagcauccuguacuucuggggcgugcaccaccccagcgugaccaccgagcaggaggcccuguacggcagcggcaacagauacgugagaaugggcaccgagagcaugaacuucgccagaagccccgagaucgccgccagacccgccgugaacggccagagaggcagaaucgacuacuucuggagcauccugaagcccggcgagacccugaacguggagagcaacggcaaccugaucgcccccugguacgccuacagauucgugaacaaggacagcaagggcgccaucuucagaagcaaccugcccaucgagaacugcgacgccaccugccagaccaucgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgacgacaaggagagcacccagaaggccaucgacggcaucaccaacaaggugaacagcaucaucgacaagaugaacacccaguucgaggccgugggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagaaggugagaagccagcugagagacaacgccaacgaccugggcaacggcugcuucgaguucuggcacaagugcgacaacgagugcauggagagcgugaagaacggcaccuacgacuaccccaaguaccaggccgagagcagacugaacagacagaagaucgagagcgugaagcuggagaacuucgacguguaccagauccuggccaucuacagcaccgugagcagcagccuggugcuggugggccugaucauggccaugggccuguggaugugcagcaacggcagcaugcagugcagaaucugcaucuga

SEQ ID NO: 163621 - RNA, 1701 nt, Artificial Sequence
  derived and/or modified sequence opt4 from hemagglutinin__InfluenzaA__AHJ57731
augaucgccuucaucgugaucgccauccuggccgccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcacccuggagggcuggauccugggcaaccccagaugcggcauccugcuggccgaccagagcuggagcuacaucguggagagacccaacgccagaaacggcaucugcuaccccggcauccugaacgaggccgaggagcugaaggcccugaucggcagcggcgagagaguggagagauucgagauguuccccaagagcaccugggccggcguggacaccgacagcggcgugagcagcgccugcccccugggcaacggccccagcuucuacagaaaccugcuguggaucaucaagcugaagagcagcgaguaccccgugaucagaggcaccuucaacaacaccggcgacaagagcauccuguacuucuggggcgugcaccacccccccgugaccaccgagcaggaggcccuguacggcagcggcaacagauacgugagaaugggcaccgagagcaugaacuucgccagaagccccgagaucgccgccagacccgccgugaacggccagagaggcagaaucgacuacuucuggagcauccugaagcccggcgagacccugaacguggagagcaacggcaaccugaucgcccccugguacgccuacagauucgugaacaaggacagcaagggcgccaucuucagaagcaaccugcccaucgagaacugcgacgccaccugccagaccaccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacagagagagcacccagaaggccaucgacggcaucaccaacaaggugaacagcaucaucgacaagaugaacacccaguucgaggccgugggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagaaggugagaagccagcugagagacaacgccaacgaccugggcaacggcugcuucgaguucuggcacaagugcgacaacgagugcauggagagcgugaagaacggcaccuacgacuaccccaaguaccagaccgagagcagacugaacagacagaagaucgagagcgugaagcuggagaacuucgacguguaccagauccuggccaucuacagcaccgugagcagcagccuggugcuggugggccugaucauggccaugggccuguggaugugcagcaacggcagcaugcagugcagaaucugcaucuga

SEQ ID NO: 163622 - RNA, 1701 nt, Artificial Sequence
  derived and/or modified sequence opt4 from hemagglutinin__InfluenzaA__AHJ57743
augaucgccuucaucgugaucgccauccugguggccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcaccaucgagggcuggauccugggcaaccccagaugcggcauccugcuggccgaccagagcuggagcuacaucguggagagacccgacgccagaaacggcaucugcuaccccggcacccugaacgaggccgaggagcugaaggcccugaucggcagcggcgagaagguggagagauucgagauguuccccaagagcaccugggccggcguggacaccagcagcggcgugagcagcgccugcccccugggcaacggccccagcuucuacagaaaccugcuguggaucaucaagcugaagagcagcgaguaccccgugaucagaggcaccuucaacaacaccggcgacaagagcgugcuguacuucuggggcgugcaccacccccccgugaccaccgagcagaacgcccuguacggcagcggcaacagauacgugagaaugggcaccgagagcaugaacuucgccagaagccccgagaucgccgccagacccgccgugaacggccagagaggcagaaucgacuacuucuggagcauccugaagcccggcgagacccugaacguggagagcaacggcaaccugaucgcccccugguacgccuacagauucgugaacaaggacagcaagggcgccaucuucagaagcaaccugcccaucgagaacugcgacgccaccugccagaccaucgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacagagagagcacccagaaggccaucgacggcaucaccaacaaggugaacagcaucaucgacaagaugaacacccaguucgaggccgccggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagaaggugaagagccagcugagagacaacgccaacgaccugggcaacggcugcuucgaguucuggcacaagugcgacaacgagugcauggagagcgugaagaacggcaccuacgacuaccccaaguaccagaaggagagcagacugaacagacagaagaucgagagcgugaagcuggagaacuucgacguguaccagauccuggccaucuacagcaccgugagcagcagccuggugcuggugggccugaucauggccaugggccuguggaugugcagcaacggcagcaugcagugcagaaucugcaucuga

SEQ ID NO: 163623 - RNA, 1701 nt, Artificial Sequence
  derived and/or modified sequence opt4 from hemagglutinin__InfluenzaA__AHJ57755
augaucgccuucaucgugaucgccauccugguggccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcaccaucgagggcuggauccugggcaaccccagaugcgacauccugcuggccgaccagagcuggagcuacaucguggagagacccaacgccagaaacggcaucugcuaccccggcacccugaacgaggccgaggagcugaaggcccugaucggcagcggcgagggcguggagagauucgagauguuccccaagagcaccugggugggcguggacaccagcagcggcgugagcagcgccugcccccugggcaacggccccagcuucuacagaaaccugcuguggaucaucaagcugaagagcagcgaguaccccgugaucagaggcaccuucaacaacaccggcgacaagagcgugcuguacuucuggggcgugcaccacccccccgugaccaccgagcagaacgcccuguacggcagcggcaacagauacgugagaaugggcaccgagagcaugaacuucgccagaagccccgagaucgccgccagacccgccgugaacggccagagaggcagaaucgacuacuucuggagcauccugaagcccggcgagacccugaacguggagagcaacggcaaccugaucgcccccugguacgccuacagauucgugaacaaggacaacaagggcgccaucuucagaagcaaccugcccaucgagaacugcgacgccaccugccagaccaccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacagagagagcacccagaaggccaucgacggcaucaccaacaaggugaacagcaucaucgacaagaugaacacccaguucgaggccgccggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagaaggugaagagccagcugagagacaacgccaacgaccugggcaacggcugcuucgaguucuggcacaagugcgacaacgagugcauggagagcgugaagaacggcaccuacgacuaccccaaguaccagaaggagagcagacugaacagacagaagaucgagagcgugaagcuggagaacuucgacguguaccagauccuggccaucuacagcaccgugagcagcagccuggugguggugggccugaucauggccaugggccuguggaugugcagcaacggcagcaugcagugcagaaucugcaucuga

SEQ ID NO: 163624 - RNA, 1701 nt, Artificial Sequence
  derived and/or modified sequence opt4 from hemagglutinin__InfluenzaA__AHJ57767
augaucgccuucaucgugaucgccauccuggccgccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcacccuggagggcuggauccugggcaaccccagaugcggcauccugcuggccgaccagagcuggagcuacaucguggagagacccaacgccagaaacggcaucugcuaccccggcacccugaacgagguggaggagcugaaggcccugaucggcagcggcgagagaguggagagauucgagauguuccccaagagcaccugggccggcguggacaccaacagcggcgugagcagcgccugcccccugggcaacggccccagcuucuacagaaaccugcuguggaucaucaagcugaagagcagcgaguaccccgugaucagaggcaccuucaacaacaccggcgacaagagcauccuguacuucuggggcgugcaccacccccccgugaccaccgagcaggaggcccuguacggcagcggcgacagauacgugagaaugggcaccgagagcaugaacuucgccagaagccccgagaucgccgccagacccgccgugaacggccagagaggcagaaucgacuacuucuggagcauccugaagcccggcgagacccugaacguggagagcaacggcaaccugaucgcccccugguacgccuacagauucgugaacaaggacagcaagggcgccaucuucagaagcaaccugcccaucgagaacugcgacgccaccugccagaccaccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagagcagccagggcagcggcuacgccgccgacaaggagagcacccagaaggccaucgacggcaucaccaacaaggugaacagcaucaucgacaagaugaacacccaguucgaggccgugggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagaaggugagaagccagcugagagacaacgccaacgaccugggcaacggcugcuucgaguucuggcacaagugcaacaacgagugcauggagagcgugaagaacggcaccuacgacuaccccaaguaccagaaggagagcagacugaacagacagaagaucgagagcgugaagcuggagaacuucgacguguaccagauccuggccaucuacagcaccgugagcagcagccuggugcuggugggccugauccuggccaugggccuguggaugugcagcaacggcagcaugcagugcagaaucugcaucuga

SEQ ID NO: 163625 - RNA, 1701 nt, Artificial Sequence
  derived and/or modified sequence opt4 from hemagglutinin__InfluenzaA__AHJ57779
augaucgccaucaucaucaucgccauccugguggccaccggcaagagcgacaagaucugcaucggcuaccacgccaacaacagcaccaccaagguggacaccauccuggagaagaacgugaccgugacccacagcguggagcugcuggaggaccagaaggaggagagauucugcaagaucagcaacaaggccccccuggaccugagagacugcaccaucgagggcuggauccugggcaaccccagaugcggcauccugcuggccgaccagagcuggagcuacaucguggagagacccaacgccagaaacggcaucugcuaccccggcacccugaacgaggccgaggagcugaaggcccugaucggcagcggcgagggcguggagagauucgagauguuccccaagagcaccugggccggcguggacaccaacagcggcgugagcagcgccugcccccugggcaacggccccagcuucuacagaaaccugcuguggaucaucaagcugaagagcagcgaguaccccgugaucagaggcaccuucaacaacaccggcgacaagagcgugcuguacuucuggggcgugcaccacccccccgugaccaccgagcagaacgcccuguacggcagcggcaacagauacgugagaaugggcaccgagagcaugaacuucgccagaagccccgagaucgccgccagacccgccgugaacggccagagaggcagaaucgacuacuucuggagcauccugaagcccggcgagacccugaacguggagagcaacggcaaccugaucgcccccugguacgccuacagauucgugaacaaggacagcaagggcgccaucuucagaagcaaccugcccaucgagaacugcgacgccaccugccagaccaccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacagagagagcacccagaaggccaucgacggcaucaccaacaaggugaacagcaucaucgacaagaugaacacccaguucgaggccgccggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagaaggugaagagccagcugagagacaacgccaacgaccugggcaacggcugcuucgaguucuggcacaagugcgacaacgagugcauggagagcgugaagaacggcaccuacgacuaccccaaguaccagaaggagagcagacugaacagacagaagaucgagagcgugaagcuggagaacuucgacguguaccagauccuggccaucuacagcaccgugagcagcagccuggugcuggugggccugaucauggccaugggccuguggaugugcagcaacggcagcaugcagugcaugaucugcaucuga

SEQ ID NO: 163626 - RNA, 1701 nt, Artificial Sequence
  derived and/or modified sequence opt4 from hemagglutinin__InfluenzaA__AHJ57791
augaucgccaucaucaucaucgccauccuggugaccaccggcaagagcgacaagaucugcaucggcuaccacgccaacaacagcaccaccaagguggacaccauccuggagaagaacgugaccgugacccacagcguggagcugcuggagaacaagaaggaggagagauucugcaagaucagcaacaaggccccccuggaccugagagacugcacccuggagggcuggauccugggcaaccccagaugcggcauccugcuggccgaccagagcuggagcuacaucguggagagacccaacgccagaaacggcaucugcuaccccggcacccugaacgaggugaaggagcugaaggcccugaucggcagcggcgagagagugaagagauucgagauguuccccaagagcaccugggccggcguggacaccaacagcggcgugagcagcagcugcccccugggcaacggccccagcuucuacagaaaccugcuguggaucaucaagcacaccaccagcggcuaccccgugaucaagggcaccuacaccaacaccggcgacaagagcgugcuguacuucuggggcauccaccacccccccgacaccaccgagcagaacgugcuguacggcagcggcaacagauacgugagaaugggcaccgagagcaugaacuucgccagaagccccgagaucgccgccagacccgccgugaacggccagagaggcagaaucgacuacuucuggagcauccugaagcccggcgagacccugaacguggagagcaacggcaaccugaucgcccccugguacgccuacagauucgugaacaaggacagcaagggcgccaucuucagaagcaaccugcccaucgaggacugcgacgccaccugccagaccaccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacagagagagcacccagaaggccaucgacggcaucaccaacaaggugaacagcaucaucgacaagaugaacacccaguucgaggccgugggccacgaguucagcaaccuggagagaagaaucgacacccugaacaagagaauggaggacggcuuccuggacguguggaccuacaacgccgagcugcuggugcugcuggagaacgagagaacccuggaccugcacgacgccaacgugaagaaccugcacgagagagugaagagccagcugagagacaacgccaacgaccugggcaacggcugcuucgaguucuggcacaagugcgacaacgagugcauggagagcgugaagaacggcaccuacaacuaccccaaguaccaggccgagagcagacugaacaagcagaagaucgagagcgugaagcuggaggaguucggcguguaccagauccuggccaucuacagcaccgugagcagcagccuggugcuggugggccugaucauggccauggugcuguggaugugcagcaacggcagcaugcagugcagagugugcaucuga

SEQ ID NO: 163627 - RNA, 1701 nt, Artificial Sequence
  derived and/or modified sequence opt4 from hemagglutinin__InfluenzaA__AHJ57815
augaucgccuucaucaucaucaccauccuggugaccaccggcaagagcgacaagaucugcaucggcuaccacgccaacaacagcaccaccaagguggacaccauccuggagaagaacgugaccgugacccacagcguggagcugcuggagaaccagaaggaggagagauucugcagaaucagcaacaaggccccccuggaccugaaggagugcacccuggagggcuggauccugggcaacccccagugcgaccugcugcugggcgaccagagcuggagcuacaucguggagagacccaacgccagaaacggcaucugcuaccccggcacccugaacgagguggaggagcugagagcccugaucggcagcggcgagggcguggagagauucgagauguuccccaagagcaccugggccggcguggacaccaacagaggcgugaccagcagcugccccuucggcagcggcagcagcuucuacagaaaccugcuguggaucgugaagcacaccaccagcagcuaccccgugaucaagggcaccuucagaaacaccggcgacaagagcgugcuguacuucuggggcgugcaccaccccuucgacaccaacgagcagaacgugcuguacggcagcggcaacagauacgugagaaugggcaccgagagcaugaacuucgccagaggccccgagguggccgccagacccguggugaacggccagagaggcagaaucgacuacuucuggagcauccugaagcccggcgagacccugaacaucgagagcaacggcaaccugaucgcccccugguacgccuacagauucgugaacaaggacagcaagggcgccaucuucagaagcaaccugcccaucgaggacugcgacgccaccugccagaccaucgagggcgugaucagaaccaacaagaccuuccagaacgugagcccccuguggaucggcgagugccccaaguacgugaagagcgagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacagagagagcacccagaaggccaucgacggcaucaccaccaaggugaacagcaucaucgacaagaugaacacccaguucgaggccgugggccacgaguucagcaaccuggagagaagaaucgacaaccugaacaagagacuggaggacggcuuccuggacguguggaccuacaacgccgagcugcuggugcugcuggagaacgagagaacccuggaccugcacgacgccaacgugaagaaccugcacgagagagugagaagccagcugagagacaacgccaacgaccugggcaacggcugcuucgaguucuggcacaagugcgacaacgagugcauggagagcgugaagaacggcaccuacaacuaccccaaguaccaggccgagagcagacugaacaagcagagaaucgagagcgugaagcuggagaacuucgacguguaccagauccuggccaucuacagcaccgugagcagcagccuggugcuggugggccugauccuggccaugggccuguggaugugcagcaacggcagcaugcagugcagaaucugcaucuga

SEQ ID NO: 163628 - RNA, 1701 nt, Artificial Sequence
  derived and/or modified sequence opt4 from hemagglutinin__InfluenzaA__AHJ57827
augaucgccuucaucgugaucgccauccugguggccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcaccaucgagggcuggauccugggcaaccccagaugcggcauccugcuggccgaccagagcuggagcuacaucguggagagacccaacgccagaaacggcaucugcuaccccggcacccugaacgagguggaggagcugaaggcccugaucggcagcggcgagagaguggagagauucgagauguuccccaagagcaccugggccggcguggacaccaacagcggcgugagcagcgccugcccccugggcaacggccccagcuucuacagaaaccugcuguggaucaucaagaccaagagcagcgaguaccccgugaucaagggcaccuucaacaacaccggcgacaagagcgugcuguacuucuggggcgugcaccacccccccagcagaaacgagcagaacgugcuguacggcagcggcgacagauacgugagaaugggcaccgagagcaugaacuucgccagaagccccgagaucgccgccagacccgccgugaacggccagagaggcagaaucgacuacuucuggagcauccugaagcccggcgagacccugaacguggagagcaacggcaaccugaucgcccccugguacgccuacagauucgugaacaaggacagcagaggcgccaucuucagaagcaaccugcccaucgagaacugcgacgccaccugccagaccgccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacagagagagcacccagaaggccaucgacggcaucaccaacaaggugaacagcaucaucgacaagaugaacacccaguucgaggccgugggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagagagugaagagccagcugagagacaacgccaacgaccugggcaacggcugcuucgaguucuggcacaagugcgacaacgagugcauggagagcgugaagaacggcaccuacgacuaccccaaguaccagaaggagagcagacugaacagacagaagaucgagagcgugaagcuggagaacuucgacguguaccagauccuggccaucuacagcaccgugagcagcagccuggugcuggugggccugaucauggccaugggccuguggaugugcagcaacggcagcaugcagugcagaaucugcaucuga

SEQ ID NO: 163629 - RNA, 1701 nt, Artificial Sequence
  derived and/or modified sequence opt4 from hemagglutinin__InfluenzaA__AHJ57850
augaucgccuucaucgugaucgccauccuggccaccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcacccuggagggcuggauccugggcaaccccagaugcggcauccugcuggccgaccagagcuggagcuacaucguggagagacccaacgccagaaacggcaucugcuaccccggcauccugaacgaggccgaggagcugaaggcccugaucggcagcggcgagagaguggagagauucgagauguuccccaagagcaccugggccggcguggacaccgacagcggcgugagcagcgccugcccccugggcaacggccccagcuucuacagaaaccugcuguggaucaucaagcugaagagcagcgaguaccccgugaucagaggcaccuucaacaacaccggcgacaagagcauccuguacuucuggggcgugcaccacccccccgugaccaccgagcaggaggcccuguacggcagcggcaacagauacgugagaaugggcaccgagagcaugaacuucgccagaacccccgagaucgccgccagacccgccgugaacggccagagaggcagaaucgacuacuucuggagcauccugaagcccggcgagacccugaacguggagagcaacggcaaccugaucgcccccugguacgccuacagauucgugaacaaggacagcaagggcgccaucuucagaagcaaccugcccaucgagaacugcgacgccaccugccagaccaccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacagagagagcacccagaaggccaucgacggcaucaccaacaaggugaacagcaucaucgacaagaugaacacccaguucgaggccgugggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagaaggugagaagccagcugagagacaacgccaacgaccugggcaacggcugcuucgaguucuggcacaagugcgacaacgagugcauggagagcgugaagaacggcaccuacgacuaccccaaguaccaggccgagagcagacugaacagacagaagaucgagagcgugaagcuggagaacuucgacguguaccagauccuggccaucuacagcaccgugagcagcagccuggugcuggugggccugaucauggccaugggccuguggaugugcagcaacggcagcaugcagugcagaaucugcaucuga

SEQ ID NO: 163630 - RNA, 1701 nt, Artificial Sequence
  derived and/or modified sequence opt4 from hemagglutinin__InfluenzaA__AHJ57862
augaucgccuucaucgugaucgccauccuggccgccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcacccuggagggcuggauccugggcaaccccagaugcggcauccugcuggccgaccagagcuggagcuacaucguggagagacccaacgccagaaacggcaucugcuaccccggcauccugaacgaggccgaggagcugaaggcccugaucggcagcggcgagagaguggagagauucgagauguuccccaagagcaccugggccggcguggacaccaacagcggcgugagcagcgccugcccccugggcaacggccccagcuucuacagaaaccugcuguggaucaucaagcugaagagcagcgaguaccccgugaucagaggcaccuucaacaacaccggcgacaagagcauccuguacuucuggggcgugcaccacccccccgugaccaccgagcaggaggcccuguacggcagcggcaacagauacgugagaaugggcaccgagagcaugaacuucgccagaagccccgagaucgccgccagacccgccgugaacggccagagaggcagaaucgacuacuucuggagcauccugaagcccggcgagacccugaacguggagagcaacggcaaccugaucgcccccugguacgccuacagauucgugaacaaggacagcaagggcgccaucuucagaagcaaccugcccaucgagaacugcgacgccaccugccagaccaccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacagagagagcacccagaaggccaucgacggcaucaccaacaaggugaacagcaucaucgacaagaugaacacccaguucgaggccgugggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagaaggugagaagccagcugagagacaacgccaacgaccugggcaacggcugcuucgaguucuggcacaagugcgacaacgagugcauggagagcgugaagaacggcaccuacgacuaccccaaguaccaggccgagagcagacugaacagacagaagaucgagagcgugaagcuggagaacuucgacguguaccagauccuggccaucuacagcaccgugagcagcagccuggugcuggugggccugaucauggccaugggccuguggaugugcagcaacggcagcaugcagugcagaaucugcaucuga

SEQ ID NO: 163631 - RNA, 1701 nt, Artificial Sequence
  derived and/or modified sequence opt4 from hemagglutinin__InfluenzaA__AHJ57873
augaucgccuucaucgugaucgccacccugguggccaccggcaagagcgacaagaucugcaugggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcacccuggagggcuggauccugggcaaccccagaugcggcauccugcuggccgaccagagcuggagcuacaucguggagagacccaacgccagaaacggcaucugcuaccccggcacccugaacgaggccgaggagcugaaggcccugaucggcagcggcgagagaguggagagauucgagauguuccccaagagcaccuggaccggcguggacaccgagagcggcgugagcagcgccugcccccugggcaacggccccagcuucuacagaaaccugcuguggaucaucaagcugaagagcagcgaguaccccgugaucagaggcaccuucaacaacaccggcgacaagagcauccuguacuucuggggcgugcaccacccccccgugaccaccgagcagaacgcccuguacggcagcggcgacagauacgugagaaugggcaccgagagcaugaacuucgccagaagccccgagaucgccgccagacccgccgugaacggccagagaggcagaaucgacuacuucuggagcauccugacccccggcgagacccugaacguggagagcaacggcaaccugaucgcccccugguacgccuacagauucgugaacaaggacagcaagggcgccaucuucagaagcaaccugcccaucgagaacugcgacgccaccugccagaccaccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacaaggagagcacccagaaggccaucgacggcaucaccaacaaggugaacagcaucaucgacaagaugaacacccaguucgaggccgugggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagaaggugagaagccagcugagagacaacgccaacgaccugggcaacggcugcuucgaguucuggcacaagugcgacaacgagugcauggagagcgugaagaacggcaccuacgacuaccccaaguaccagaaggagagcagacugaacagacagaagaucgagagcgugaagcuggagaacuucgacguguaccagauccuggccaucuacagcaccgugagcagcagccuggugcuggugggccugauccuggccaugggccuguggaugugcagcaacggcagcaugcacugcagaaucugcaucuga

SEQ ID NO: 163632 - RNA, 1701 nt, Artificial Sequence
  derived and/or modified sequence opt4 from hemagglutinin__InfluenzaA__AHJ57885
augaucgccuucaucgugauggccauccuggccgccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcacccuggagggcuggauccugggcaaccccagaugcggcauccugcuggccgaccagagcuggagcuacaucguggagagacccaacgccagaaacggcaucugcuaccccggcauccugaacgaggccgaggagcugaaggcccugaucggcagcggcgagagaguggagagauucgagauguuccccaagagcaccugggccggcguggacaccgacagcggcgugagcagcgccugcccccugggcaacggccccagcuucuacagaaaccugcuguggaucaucaagagaaagagcagcgccuaccccgugaucagaggcaccuucaacaacaccggcgacaagagcauccuguacuucuggggcgugcaccacccccccgugaccaccgagcaggaggcccuguacggcagcggcaacagauacgugagaaugggcaccgagagcaugaacuucgccagaaaccccgagaucgccgccagacccgccgugaacggccagagaggcagaaucgacuacuucuggagcauccugaagcccggcgagacccugaacaucgagagcaacggcaaccugaucgcccccugguacgccuacagauucgugaacaaggacagcaagggcgccaucuucagaagcaaccugcccaucgaggacugcgacgccagcugccagaccaccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacagagagagcacccagaaggccaucgacggcaucaccaacaaggugaacagcaucaucgacaagaugaacacccaguucgaggccgugggccacgaguucagcaaccuggagagaagaaucgacaaccuggacaagagaauggaggacggcuuccuggacguguggaccuacaacgccgagcugcuggugcugcuggagaacgagagaacccuggaccugcacgacgccaacgugaagaaccugcacgagaaggugagaagccagcugagagacaacgccaacgaccugggcaacggcugcuucgaguucuggcacaagugcgacaacgagugcauggagagcgugaagaacggcaccuacgacuaccccaaguaccaggccgagagcagacugaacagacagaagaucgagagcgugaagcuggagaacuucgacguguaccagauccuggccaucuacagcaccgugagcagcagccuggugcuggugggccugaucauggccaugggccuguggaugugcagcaacggcagcaugcagugcagaaucugcaucuga

SEQ ID NO: 163633 - RNA, 1701 nt, Artificial Sequence
  derived and/or modified sequence opt4 from hemagglutinin__InfluenzaA__AHJ57897
augaucgccuucaucgugaucgccauccuggccgccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcacccuggagggcuggauccugggcaaccccagaugcggcauccugcuggccgaccagagcuggagcuacaucguggagagacccaacgccagaaacggcaucugcuaccccggcauccugaacgaggccgaggagcugaaggcccugaucggcagcggcgagagaguggagagauucgagauguuccccaagagcaccugggccggcguggacaccgacagcggcgugagcagcgccugcccccugggcaacggccccagcuucuacagaaaccugcuguggaucaucaagagaaagagcagcgccuaccccgugaucagaggcaccuucaacaacaccggcgacaagagcauccuguacuucuggggcgugcaccacccccccgugaccaccgagcaggaggcccuguacggcagcggcaacagauacgugagaaugggcaccgagagcaugaacuucgccagaaaccccgagaucgccgccagacccgccgugaacggccagagaggcagaaucgacuacuucuggagcauccugaagcccggcgagacccugaacaucgagagcaacggcaaccugaucgcccccugguacgccuacagauucgugaacaaggacagcaagggcgccaucuucagaagcaaccugcccaucgaggacugcgacgccagcugccagaccaccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacagagagagcacccagaaggccaucgacggcaucaccaacaaggugaacagcaucaucgacaagaugaacacccaguucgaggccgugggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagaaggugagaagccagcugagagacaacgccaacgaccugggcaacggcugcuucgaguucuggcacaagugcgacaacgagugcauggagagcgugaagaacggcaccuacgacuaccccaaguaccaggccgagagcagacugaacagacagaagaucgagagcgugaagcuggagaacuucgacguguaccagauccuggccaucuacagcaccgugagcagcagccuggugcuggugggccugaucauggccaugggccuguggaugugcagcaacggcagcaugcagugcagaaucugcaucuga

SEQ ID NO: 163634 - RNA, 1701 nt, Artificial Sequence
  derived and/or modified sequence opt4 from hemagglutinin__InfluenzaA__AHJ57908
augaucgccuucaucgugaucgccauccugguggccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcaccguggagggcuggauccugggcaaccccagaugcggcauccugaucgccgaccagagcuggagcuacaucguggagagacccaacgccagaaacggcaucugcuaccccggcacccugaacgaggccgaggagcugaaggcccugaucggcagcggcgagggcguggagagauucgagauguuccccaagagcaccugggccggcguggacaccagcagcggcgugagcagcgccugcccccugggcaacggccccagcuucuacagaaaccugcuguggaucaucaagcugaagagcagcgaguaccccgugaucagaggcaccuucaacaacaccggcgacaagagcgugcuguacuucuggggcgugcaccacccccccgugaccaccgagcaggacgcccuguacggcagcggcaacagauacgugagaaugggcaccgagagcaugaacuucgccagaagccccgagaucgccgccagacccgccgugaacggccagagaggcagaaucgacuacuucuggagcgugcugaagcccggcgagacccugaacguggagagcaacggcaaccugaucgcccccugguacgccuacagauucgugaacaaggacaacaagggcgccaucuucagaagcaaccugcccaucgagaacugcgacgccaccugccagaccaccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacagagagagcacccagaaggccaucgacggcaucaccaacaaggugaacagcaucaucgacaagaugaacacccaguucgaggccgccggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagaaggugaagagccagcugagagacaacgccaacgaccugggcaacggcugcuucgaguucuggcacaagugcgacaacgagugcauggagagcgugaagaacggcaccuacgacuaccccaaguaccagaaggagagcagacugaacagacagagaaucgagagcgugaagcuggagaacuucgacguguaccagauccuggccaucuacagcaccgugagcagcagccuggugguggugggccugaucauggccaugggccuguggaugugcagcaacggcagcaugcagugcaugaucugcaucuga

SEQ ID NO: 163635 - RNA, 1701 nt, Artificial Sequence
  derived and/or modified sequence opt4 from hemagglutinin__InfluenzaA__AHJ57920
augaucgccaucaucaucaucgccauccugguggccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcaccaucgagggcuggauccugggcaaccccuggugcggcauccugcuggccgaccagagcuggagcuacaucguggagagacccaacgccagaaacggcaucugcuaccccggcacccugaacgagguggaggagcugaaggcccugaucggcagcggcgagagaguggagagauucgagauguuccccaagagcaccugggccggcguggacaccaacagcggcgugagcagcgccugcccccugggcaacggccccagcuucuacagaaaccugcuguggaucaucaagaccaagagcagcgaguaccccgugaucaagggcaccuucaacaacaccggcgacaagagcgugcuguacuucuggggcgugcaccacccccccagcagaaacgagcagaacgugcuguacggcagcggcgacagauacgugagaaugggcaccgagagcaugaacuucgccagaagccccgagaucgccgccagacccgccgugaacggccagagaggcagaaucgacuacuucuggagcauccugaagcccggcgagacccugaacguggagagcaacggcaaccugaucgcccccugguacgccuacagauucgugaacaaggacagcagaggcgccaucuucagaagcaaccugcccaucgagaacugcgacgccaccugccagaccgccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacagagagagcacccagaaggccaccgacggcaucaccaacaaggugaacagcaucaucgacaagaugaacacccaguucgaggccgugggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagagagugaagagccagcugagagacaacgccaacgaccugggcaacggcugcuucgaguucuggcacaagugcgacaacgagugcauggagagcgugaagaacgacaccuacgacuaccccaaguaccagaaggagagcagacugaacagacagaagaucgagagcgugagacuggagaacuucgacguguaccagauccuggccaucuacagcaccgugagcagcagccuggugcuggugggccugaucauggccaugggccuguggaugugcagcaacggcagcaugcagugcagaaucugcaucuga

SEQ ID NO: 163636 - RNA, 1701 nt, Artificial Sequence
  derived and/or modified sequence opt4 from hemagglutinin__InfluenzaA__AHJ57932
augaucgcccugaucaucaucaccauccuggugaccaccggcaagagcgacaagaucugcaucggcuaccacgccaacaacagcaccaccaagguggacaccauccuggagaagaacgugaccgugacccacagcguggagcugcuggagaaccagaaggaggagagauucugcagaaucagcaacaaggccccccuggaccugaaggagugcacccuggagggcuggauccugggcaacccccagugcgaccugcugcugggcgaccagagcuggagcuacaucguggagagacccaacgccagaaacggcaucugcuaccccggcacccugaacgagguggaggagcugagagcccugaucggcagcggcgagggcguggagagauucgagauguuccccaagagcaccugggccggcguggacaccaacagaggcgugaccagcagcugccccuucggcagcggcagcagcuucuacagaaaccugcuguggaucgugaagcacaccaccagcagcuaccccgugaucaagggcaccuucagaaacaccggcgacaagagcgugcuguacuucuggggcgugcaccaccccuucgacaccaacgagcagaacgugcuguacggcagcggcaacagauacgugagaaugggcaccgagagcaugaacuucgccagaggccccgagguggccgccagacccguggugaacggccagagaggcagaaucgacuacuucuggagcauccugaagcccggcgagacccugaacaucgagagcaacggcaaccugaucgcccccugguacgccuacagauucgugaacaaggacagcaagggcgccaucuucagaagcaaccugcccaucgaggacugcgacgccaccugccagaccaucgagggcgugaucagaaccaacaagaccuuccagaacgugagcccccuguggaucggcgagugccccaaguacgugaagagcgagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacagagagagcacccagaaggccaucgacggcaucaccaccaaggugaacagcaucaucgacaagaugaacacccaguucgaggccgugggccacgaguucagcaaccuggagagaagaaucgacaaccugaacaagagacuggaggacggcuuccuggacguguggaccuacaacgccgagcugcuggugcugcuggagaacgagagaacccuggaccugcacgacgccaacgugaagaaccugcacgagagagugagaagccagcugagagacaacgccaacgaccugggcaacggcugcuucgaguucuggcacaagugcgacaacgagugcauggagagcgugagaaacggcaccuacaacuaccccaaguaccaggccgagagcagacugaacaagcagagaaucgagagcgugaagcuggagaacuucgacguguaccagauccuggccaucuacagcaccgugagcagcagccuggugcuggugggccugauccuggccaugggccuguggaugugcagcaacggcagcaugcagugcagaaucugcaucuga

SEQ ID NO: 163637 - RNA, 1701 nt, Artificial Sequence
  derived and/or modified sequence opt4 from hemagglutinin__InfluenzaA__AHJ57943
augaucgccuucaucgugaucgccacccugguggccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcacccuggagggcuggauccugggcaaccccagaugcggcauccugcuggccgaccagagcuggagcuacaucguggagagacccaacgccagaaacggcaucugcuaccccggcacccugaacgaggccgaggagcugaaggcccugaucggcagcggcgagagaguggagagauucgagauguuccccaagagcaccuggaccggcguggacaccgagagcggcgugagcagcgccugcccccugggcaacggccccagcuucuacagaaaccugcuguggaucaucaagcugaagagcagcgaguaccccgugaucagaggcaccuucaacaacaccggcgacaagagcauccuguacuucuggggcgugcaccacccccccgugaccaccgagcagaacgcccuguacggcagcggcgacagauacgugagaaugggcaccgagagcaugaacuucgccagaagccccgagaucgccgccagacccgccgugaacggccagagaggcagaaucgacuacuucuggagcauccugaagcccggcgagacccugaacguggagagcaacggcaaccugaucgcccccugguacgccuacagauucgugaacaaggacagcaagggcgccaucuucagaagcaaccugcccaucgagaacugcgacgccaccugccagaccaccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacaaggagagcacccagaaggccaucgacggcaucaccaacaaggugaacagcaucaucgacaagaugaacacccaguucgagaccgugggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagaaggugagaagccagcugagagacaacgccaacgaccugggcaacggcugcuucgaguucuggcacaagugcaacaacgagugcauggagagcgugaagaacggcaccuacgacuaccccaaguaccagaaggagagcagacugaacagacagaagaucgagagcgugaagcuggagaacuucgacguguaccagauccuggccaucuacagcaccgugagcagcagccuggugcuggugggccugauccuggccaugggccuguggaugugcagcaacggcagcaugcagugcagaaucugcaucuga

SEQ ID NO: 163638 - RNA, 1701 nt, Artificial Sequence
  derived and/or modified sequence opt4 from hemagglutinin__InfluenzaA__AHJ57954
augaucgccuucaucgugaucgccauccuggccgccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcacccuggagggcuggauccugggcaaccccagaugcggcauccugcuggccgaccagagcuggagcuacaucguggagagacccaacgccagaaacggcaucugcuaccccggcauccugaacgaggccgaggagcugaaggcccugaucggcagcggcgagagaguggagagauucgagauguuccccaagagcaccugggccggcguggacaccaacagcggcgugagcagcgccugcccccugggcaacggccccagcuucuacagaaaccugcuguggaucaucaagcagaagagcagcgccuaccccgugaucagaggcaccuucaacaacaccggcgacaagagcauccuguacuucuggggcgugcaccacccccccgugaccaccgagcaggaggcccuguacggcagcggcaacagauacgugagaaugggcaccgagagcaugaacuucgccagaaaccccgagaucgccgccagacccgccgugaacggccagagaggcagaaucgacuacuucuggagcauccugaagcccggcgagacccugaacguggagagcaacggcaaccugaucgcccccugguacgccuacagauucgugaacaaggacagcaagggcgccaucuucagaagcaaccugcccaucgagaacugcgacgccaccugccagaccaccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacagagagagcacccagaaggccaucgacggcaucaccaacaaggugaacagcaucaucgacaagaugaacacccaguucgaggccgugggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagaaggugagaagccagcugagagacaacgccaacgaccugggcaacggcugcuucgaguucuggcacaagugcgacaacgagugcauggagagcgugaagaacggcaccuacgacuaccccaaguaccaggccgagagcagacugaacagacagaagaucgagagcgugaagcuggagaacuucgacguguaccagauccuggccaucuacagcaccgugagcagcagccuggugcuggugggccugaucauggccaugggccuguggaugugcagcaacggcagcaugcagugcagaaucugcaucuga

SEQ ID NO: 163639 - RNA, 1701 nt, Artificial Sequence
  derived and/or modified sequence opt4 from hemagglutinin__InfluenzaA__AHJ57965
augaucgccuucaucaucaucaccauccuggugaccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugaaggagugcacccuggagggcuggauccugggcaacccccagugcgaccugcugcugggcgaccagagcuggagcuacaucguggagagacccaacgccagaaacggcaucugcuaccccggcacccugaacgagguggaggagcugaaggcccugaucggcagcggcgagagaguggagagauucgagauguuccccaagagcaccugggccggcguggacaccaacagcggcgugaccagcagcugcagcuucggcagcggcagcagcuucuacagaaaccugcuguggaucaucaagcacaccaccagcagcuaccccgugaucaagggcaccuucagaaacaccggcgacaagagcgugcuguacuucuggggcgugcaccaccccaucgacaccaccgagcagaacgugcuguacggcagcggcaacagauacgugagaaugggcaccgagagcaugaacuucgccagaagccccgagaucgccgccagacccguggugaacggccagagaggcagaaucgacuacuucuggagcauccugaagcccggcgagacccugaacaucgagagcaacggcaaccugaucgcccccugguacgccuacagauucgugaacaaggacagcaagggcgccaucuucagaagcaaccugcccaucgagaacugcgacgccaccugccagaccaucgagggcgugaucagaaccaacaagaccuuccagaacgugagcccccuguggaucggcgagugccccaaguacgugaagagcgagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacagagagagcacccagagagccaucgacggcaucaccaccaaggugaacagcaucaucgacaagaugaacacccaguucgaggccgugggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagagagugagaagccagcugagagacaacgccaacgacggcggcaacggcugcuucgaguucuggcacaagugcgacaacgagugcauggagagcgugaagaacggcaccuacgacuaccccaaguaccaggccgagagcagaagcaacagacagagaaucgagagcgugaagcuggagaacuucgacguguaccagauccuggccaucuacagcaccgugagcagcagccugguggugguguggcugauccuggccaugggccuguggaugugcgccaacggcagcaugcagugcagaaucugcaucuga

SEQ ID NO: 163640 - RNA, 1701 nt, Artificial Sequence
  derived and/or modified sequence opt4 from hemagglutinin__InfluenzaA__AHJ57977
augaucgccuucaucgugaucgccauccuggccgccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcaccaucgagggcuggauccugggcaaccccagaugcggcauccugcuggccgaccagagcuggagcuacaucguggagagacccaacgccagaaacggcaucugcuaccccggcacccugaacgagguggaggagcugaaggcccugaucggcagcggcgagagaguggagagauucgagauguuccccaagagcaccugggccggcguggacaccaacagcggcgugagcagcgccugcccccugggcaacggccccagcuucuacagaaaccugcuguggaucaucaagcugaagagcagcgaguaccccgugaucagaggcaccuucaacaacaccggcgacaagagcauccuguacuucuggggcgugcaccacccccccgugaccaccgagcaggaggcccuguacggcagcggcgacagauacgugagaaugggcaccgagagcaugaacuucgccagaagccccgagaucgccgccagacccgccgugaacggccagagaggcagaaucgacuacuucuggagcauccugaagcccggcgagacccugaacguggagagcaacggcaaccugaucgcccccugguacgccuacagauucgugaacaaggacagcaagggcgccaucuucagaagcaaccugcccaucgagaacugcgacgccaccugccagaccaccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacaaggagagcacccagaaggccaucgacggcaucaccaacaaggugaacagcaucaucgacaagaugaacacccaguucgaggccgugggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagaaggugagaagccagcugagagacaacgccaacgaccugggcaacggcugcuucgaguucuggcacaagugcaacaacgagugcauggagagcgugaagaacggcaccuacgacuaccccaaguaccagaaggagagcagacugaacagacagaagaucgagagcgugaagcuggagaacuucgacguguaccagauccuggccaucuacagcaccgugagcagcagccuggugcuggugggccugauccuggccaugggccuguggaugugcagcaacggcagcaugcagugcagaaucugcaucuga

SEQ ID NO: 163641 - RNA, 1701 nt, Artificial Sequence
  derived and/or modified sequence opt4 from hemagglutinin__InfluenzaA__AHJ57989
augaucgccuucaucgugaucgccauccuggugaccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcacccuggagggcuggauccugggcaaccccagaugcggcauccugcuggccgaccagagcuggagcuacaucguggagagacccaacgccagaaacggcaucugcuaccccggcacccugaacgagguggaggagcugaaggcccugaucggcagcggcgagagaguggagagauucgagauguuccccaagagcaccugggccagaguggacaccgacagaggcgugagcagcgccugcccccugggcaacggccccagcuucuacagaaaccugcuguggaucgugaagcacaccaccagcgaguaccccgugaucaagggcaccuacaccaacaccggcgacaagagcgugcuguacuucuggggcgugcaccacccccccgacaccaccgagcagaacgugcuguacggcagcggcaacagauacgugagaaugggcaccgagagcaugaacuucgccagaagccccgagaucgccgccagacccgccgugaacggccagagaggcagaaucgacuacuucuggagcauccugaagcccggcgagacccugaacguggagagcaacggcaaccugaucgcccccugguacgccuacagauucgugaacaaggacagcaagggcgccaucuucagaagcaaccugcccaucgagaacugcgacgccaccugccagaccaccgagggcgugaucagaaccaacaagaccuuccagaacgugagccccauguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacagagagagcacccagaaggccaucgacggcaucaccaacaaggugaacagcaucaucgacaagaugaacacccaguucgaggccgugggccacgaguucagcaaccuggagagaagaaucgacaaccugaacaagagaauggaggacggcuuccuggacguguggaccuacaacgccgagcugcuggugcugcuggagaacgagagaacccuggaccugcacgacagcaacgugaagaaccugcacgagagagugaagagccagcugagagacaacgccaacgaccugggcaacggcugcuucgaguucuggcacaagugcgacaacgagugcauggagagcgugaagaacggcaccuacaacuaccccaaguaccaggccgagagcagacugaacagacagaagaucgagagcgugaagcuggaggaguucggcguguaccagauccuggccaucuacagcaccgugagcagcagccuggugcuggugggccugaucauggccaugggccuguggaugugcagcaacggcagcaugcagugcagaaucugcaucuga

SEQ ID NO: 163642 - RNA, 1701 nt, Artificial Sequence
  derived and/or modified sequence opt4 from hemagglutinin__InfluenzaA__AHJ58001
augaucgccuucaucgugaucgccauccuggccgccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcacccuggagggcuggauccugggcaaccccagaugcggcauccugcuggccgaccagagcuggagcuacaucguggagagacccaacgccagaaacggcaucugcuaccccggcauccugaacgaggccgaggagcugaaggcccugaucggcagcggcgagagaguggagagauucgagauguuccccaagagcaccugggccggcguggacaccgacagcggcgugagcagcgccugcccccugggcaacggccccagcuucuacagaaaccugcuguggaucaucaagcugaagagcagcgaguaccccgugaucagaggcaccuucaacaacaccggcgacaagagcauccuguacuucuggggcgugcaccacccccccgugaccaccgagcaggaggcccuguacggcagcggcaacagauacgugagaaugggcaccgagagcaugaacuucgccagaagccccgagaucgccgccagacccgccgugaacggccagagaggcagaaucgacuacuucuggagcauccugaagcccggcgagacccugaacguggagagcaacggcaaccugaucgcccccugguacgccuacagauucgugaacaaggacagcaagggcgccaucuucagaagcaaccugcccaucgagaacugcgacgccaccugccagaccaccgagggcgugaucagaaccaacaagaccuuccagaacgugagccccauguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacagagagagcacccagaaggccaucgacggcaucaccaacaaggugaacagcaucaucgacaagaugaacacccaguucgaggccgugggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagaaggugagaagccagcugagagacaacgccaacgaccugggcaacggcugcuucgaguucuggcacaagugcgacaacgagugcauggagagcgugaagaacggcaccuacgacuaccccaaguaccagaccgagagcagacugaacagacagaagaucgagagcgugaagcuggagaacuucgacguguaccagauccuggccaucuacagcaccgugagcagcagccuggugcuggugggccugaucauggccaugggccuguggaugugcagcaacggcagcaugcagugcagaaucugcaucuga

SEQ ID NO: 163643 - RNA, 1701 nt, Artificial Sequence
  derived and/or modified sequence opt4 from hemagglutinin__InfluenzaA__AHJ58013
augaucgccuucaucgugaucgccauccuggugaccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcagcaaggccccccuggaccugagagacugcagccuggagggcuggauccugggcaaccccagaugcggcauccugcuggccgaccagagcuggagcuacaucguggagagacccaacgccagaaacggcaucugcuaccccggcacccugaacgagguggaggagcugaaggcccugaucggcagcggcgagagaguggagagauucgagauguuccccaagagcaccugggccggcguggacaccaacagcggcgugagcagcgccugcccccugggcgagggccccagcuucuacagaaaccugcuguggaucaucaagagaaccaccagcgaguaccccgugaucaagggcaccuacagaaacaccggcgacaagagcgugcuguacuucuggggcgugcaccacccccccgacaccaccgagcagaacgugcuguacggcagcggcaacagauacgugagaaugggcaccgagagcaugaacuucgccagaagccccgagaucgccgccagacccgccgugaacggccagagaggcagaaucgacuacuucuggagcauccugaagcccggcgagacccuggacguggagagcaacggcaaccugaucgcccccugguacgccuacagauucgugaacaaggagagcaagggcgccaucuucagaagcaaccugcccaucgagaacugcgacgccaccugccagaccaccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacaaggagagcacccagaaggccaucgacggcaucaccaacaaggugaacagcaucaucgacaagaugaacacccaguucgaggccgugggccacgaguucagcacccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagagagugagaagccagcugagagacaacgccaacgaccugggcaacggcugcuucgaguucuggcacaagugcgacaacgagugcauggagagcgugaagaacggcaccuacaacuaccccaaguaccaggccgagagcagacugaacaagcagaagaucgagagcgugaagcuggaggaguucggcguguaccagauccuggccaucuacagcaccgugagcagcagccuggugcuggugggccugaucauggccaugggccuguggaugugcagcaacggcagcaugcagugcagaaucugcaucuga

SEQ ID NO: 163644 - RNA, 1701 nt, Artificial Sequence
  derived and/or modified sequence opt4 from hemagglutinin__InfluenzaA__AHJ58025
augaucgccuucaucgugaucgccauccuggugaccaccggcgagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcaccaucgagggcuggauccugggcaaccccagaugcggcauccugcuggccgaccagagcuggagcuacaucguggagagacccaacgccagaaacggcaucugcuaccccggcacccugaacgaggccgaggagcugaaggcccugaucggcagcggcgagggcguggagagauucgagauguuccccaagagcaccugggccggcguggacaccaacagcggcgugagcagcgccugcccccugggcaacggccccagcuucuacagaaaccugcuguggaucaucaagcugaagagcagcgaguaccccgugaucagaggcaccuucaacaacaccggcgacaagagcgugcuguacuucuggggcgugcaccacccccccgugaccaccgagcagaacgaccuguacggcagcggcaacagauacgugagaaugggcaccgagagcaugaacuucgccagaaaccccgagaucgcccugagacccgccgugaacggccagagaggcagaaucgacuacuucuggagcauccugaagcccggcgagacccugaacguggagagcaacggcaaccugaucgcccccugguacgccuacagauucgugaacaaggacagcaagggcgccaucuucagaagcagccugcccaucgagaacugcgacgccaccugccagaccgccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugguggacggcugguacggcuaccaccacgagaacagccagggcagcggcuacgccgccgacagagagagcacccagaaggccaucgacggcaucaccaacaaggugaacagcaucaucgacaagaugaacacccaguucgaggccguggaccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagaaggugaagagccagcugagagacaacgccaacgaccugggcaacggcugcuucgaguucuggcacaagugcgacaacgagugcauggagagcgugaagaacggcaccuacaacuaccccaaguaccagaaggagagcagacugaacagacagaagaucgagagcgugaagcuggagaacuucgacguguaccagauccuggccaucuacagcaccgugagcagcagccuggugcuggugggccugaucauggccaugggccuguggaugugcagcaacggcagcaugcagugcagaaucugcaucuga

SEQ ID NO: 163645 - RNA, 1701 nt, Artificial Sequence
  derived and/or modified sequence opt4 from hemagglutinin__InfluenzaA__AHJ58037
augaucgccuucaucaucaucaccauccuggugaccaccggcgagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugaaggagugcacccuggagggcuggauccugggcaacccccagugcgaccugcugcugggcgaccagagcuggagcuacaucguggagagacccaacgccagaaacggcaucugcuaccccggcacccugaacgagguggaggagcugaaggcccugaucggcagcggcgagagaguggagagauucgagauguuccccaagagcaccugggccggcguggacaccaacagcggcgugaccagaagcugccccuucggcagcggcagcagcuucuacagaaaccugcuguggaucaucaagcacaccaccagcagcuaccccgugaucaagggcaccuucagaaacaccggcgacaagagcgugcuguacuucuggggcgugcaccaccccaucgacaccaccgagcagaacgugcuguacggcagcggcaacagauacgugagaaugggcaccgagagcaugaacuucgccagaagccccgagaucgccgccagacccguggugaacggccagagaggcagaaucgacuacuucuggagcauccugaagcccggcgagacccugaacaucgagagcaacggcaaccugaucgcccccugguacgccuacagauucgugaacaaggacagcaagggcgccaucuucagaagcaaccugcccaucgagaacugcgacgccaccugccagaccaucgagggcgugaucagaaccaacaagaccuuccagaacgugagcccccuguggaucggcgagugccccaaguacgugaagagcgagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacagagagagcacccagagagccaucgacggcaucaccaccaaggugaacagcaucaucgacaagaugaacacccaguucgaggccgugggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagagagugaagagccagcugagagacaacgccaacgaccugggcaacggcugcuucgaguucuggcacaagugcgacaacgagugcauggagagcgugaagaacggcaccuacgacuaccccaaguaccaggccgagagcagacugaacaagcagagaaucgagagcgugaagcuggagaacuucgacguguaccagauccuggccaucuacagcaccgugagcagcagccuggugcuggugggccugaucauggccaucggccuguggaugugcagcaacggcagcaugcagugcagaaucugcaucuga

SEQ ID NO: 163646 - RNA, 1701 nt, Artificial Sequence
  derived and/or modified sequence opt4 from hemagglutinin__InfluenzaA__AHJ58049
augaucgccuucaucgugaucgccauccuggccgccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcacccuggagggcuggauccugggcaaccccagaugcggcauccugcuggccgaccagagcuggagcuacaucguggagagacccaacgccagaaacggcaucugcuaccccggcauccugaacgaggccgaggagcugaaggcccugaucggcagcggcgagagaguggagagauucgagauguuccccaagagcaccugggccggcguggacaccgacagcggcgugagcagcgccugcccccugggcaacggccccagcuucuacagaaaccugcuguggaucaucaagcugaagagcagcgaguaccccgugaucagaggcaccuucaacaacaccggcgacaagagcauccuguacuucuggggcgugcaccacccccccgugaccaccgagcaggaggcccuguacggcagcggcaacagauacgugagaaugggcaccgagagcaugaacuucgccagaacccccgagaucgccgccagacccgccgugaacggccagagaggcagaaucgacuacuucuggagcauccugaagcccggcgagacccugaacguggagagcaacggcaaccugaucgcccccugguacgccuacagauucgugaacaaggacagcaagggcgccaucuucagaagcaaccugcccaucgagaacugcgacgccaccugccagaccaccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacagagagagcacccagaaggccaucgacggcaucaccaacaaggugaacagcaucaucgacaagaugaacacccaguucgaggccgugggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagaaggugagaagccagcugagagacaacgccaacgaccugggcaacggcugcuucgaguucuggcacaagugcgacaacgagugcauggagagcgugaagaacggcaccuacgacuaccccaaguaccaggccgagagcagacugaacagacagaagaucgagagcgugaagcuggagaacuucgacguguaccagauccuggccaucuacagcaccgugagcagcagccuggugcuggugggccugaucauggccaugggccuguggaugugcagcaacggcagcaugcagugcagaaucugcaucuga

SEQ ID NO: 163647 - RNA, 1701 nt, Artificial Sequence
  derived and/or modified sequence opt4 from hemagglutinin__InfluenzaA__AHJ58061
augaucgccuucaucgugaucgccacccugguggccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcacccuggagggcuggauccugggcaaccccagaugcggcauccugcuggccgaccagagcuggagcuacaucguggagagacccaacgccagaaacggcaucugcuaccccggcacccugaacgaggccgaggagcugaaggcccugaucggcagcggcgagagaguggagagauucgagauguuccccaagagcaccuggaccggcguggacaccgagagcggcgugagcagcgccugcccccugggcaacggccccagcuucuacagaaaccugcuguggaucaucaagcugaagagcagcgaguaccccgugaucagaggcaccuucaacaacaccggcgacaagagcauccuguacuucuggggcgugcaccacccccccgugaccaccgagcagaacgcccuguacggcagcggcgacagauacgugagaaugggcaccgagagcaugaacuucgccagaagccccgagaucgccgccagacccgccgugaacggccagagaggcagaaucgacuacuucuggagcauccugaagcccggcgagacccugaacguggagagcaacggcaaccugaucgcccccugguacgccuacagauucgugaacaaggacagcaagggcgccaucuucagaagcaaccugcccaucgagaacugcgacgccaccugccagaccaccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacaaggagagcacccagaaggccaucgacggcaucaccaacaaggugaacagcaucaucgacaagaugaacacccaguucgaggccgugggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagaaggugagaagccagcugagagacaacgccaacgaccugggcaacggcugcuucgaguucuggcacaagugcaacaacgagugcauggagagcgugaagaacggcaccuacgacuaccccaaguaccagaaggagagcagacugaacagacagaagaucgagagcgugaagcuggagaacuucgacguguaccagauccuggccaucuacagcaccgugagcagcagccuggugcuggugggccugauccuggccaugggccuguggaugugcagcaacggcagcaugcagugcagaaucugcaucuga

SEQ ID NO: 163648 - RNA, 1701 nt, Artificial Sequence
  derived and/or modified sequence opt4 from hemagglutinin__InfluenzaA__AHJ58084
augaucgccuucaucgugaucgccacccugguggccaccggcaagagcgacaagaucugcaucggcuaccacgccaacaacagcaccaccaagguggacaccauccuggagaagaacgugaccgugacccacagcguggagcugcuggagaaccagaaggaggagagauucugcaagaucagcaacaaggccccccuggaccugagagacugcacccuggagggcuggauccugggcaaccccagaugcggcauccugcuggccgaccagagcuggagcuacaucguggagagacccaacgccagaaacggcaucugcuaccccggcacccugaacgaggccgaggagcugaaggcccugaucggcagcggcgagagaguggagagauucgagauguuccccaagagcaccuggaccggcgugaacaccgagagcggcgugagcagcgccugcccccugggcaacggccccagcuucuacagaaaccugcuguggaucaucaagcugaagagcagcgaguaccccgugaucagaggcaccuucaacaacaccggcgacaagagcauccuguacuucuggggcgugcaccacccccccgugaccaccgagcagaacgcccuguacggcagcggcgacagauacgugagaaugggcaccgagagcaugaacuucgccagaagccccgagaucgccgccagacccgccgugaacggccagagaggcagaaucgacuacuucuggagcauccugaagcccggcgagacccugaacguggagagcaacggcaaccugaucgcccccugguacgccuacagauucgugaacaaggacagcaagggcgccaucuucagaagcaaccugcccaucgagaacugcgacgccaccugccagaccaccgagggcgugaucagaaccaacaagaccuuccagaacgugagcccccuguggaucggcgagugccccaaguacgugaagagcaagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacaaggagagcacccagaaggccaucgacggcaucaccaacaaggugaacagcaucaucgacaagaugaacacccaguucgaggccgugggccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccugcacgagaaggugagaagccagcugagagacaacgccaacgaccugggcaacggcugcuucgaguucuggcacaagugcaacaacgagugcauggagagcgugaagaacggcaccuacgacuaccccaaguaccagaaggagagcagacugaacagacagaagaucgagagcgugaagcuggagaacuucgacguguaccagauccuggccaucuacagcaccgugagcagcagccuggugcuggugggccugauccuggccaugggccuguggaugugcagcaacggcagcaugcagugcagaaucugcaucuga

SEQ ID NO: 163649 - RNA, 1701 nt, Artificial Sequence; identical to SEQ ID NO: 159375
  derived and/or modified sequence opt4 from hemagglutinin__InfluenzaA__AHL80708

SEQ ID NO: 163650 - RNA, 1701 nt, Artificial Sequence
  derived and/or modified sequence opt4 from hemagglutinin__InfluenzaA__AHL80718
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaucagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacaccagcgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163651 - RNA, 1710 nt, Artificial Sequence
  derived and/or modified sequence opt4 from hemagglutinin__InfluenzaA__AHL80729
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcgagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163652 - RNA, 1701 nt, Artificial Sequence
  derived and/or modified sequence opt4 from hemagglutinin__InfluenzaA__AHL80740
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagcugcugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcgugcaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163653 - RNA, 1701 nt, Artificial Sequence
  derived and/or modified sequence opt4 from hemagglutinin__InfluenzaA__AHL80751
augaaggccauccugguggugcugcuguacaccuucgccaccgccaacgccgacacccugugcaucggcuaccacgccaacaacagcaccgacaccguggacaccauccuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggagauccuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagaagaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163654 - RNA, 1701 nt, Artificial Sequence
  derived and/or modified sequence opt4 from hemagglutinin__InfluenzaA__AHL80762
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggauccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaaggacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163655 - RNA, 1701 nt, Artificial Sequence
  derived and/or modified sequence opt4 from hemagglutinin__InfluenzaA__AHL80784
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcaucaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163656 - RNA, 1701 nt, Artificial Sequence; identical to SEQ ID NO: 156353
  derived and/or modified sequence opt4 from hemagglutinin__InfluenzaA__AHL80795

SEQ ID NO: 163657 - RNA, 1701 nt, Artificial Sequence
  derived and/or modified sequence opt4 from hemagglutinin__InfluenzaA__AHL80817
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaacugcaacaucgccggcuggauccugggcaaccccgagugcgagagccugagcaccgccagcagcuggagcuacaucguggaggccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163658 - RNA, 1701 nt, Artificial Sequence; identical to SEQ ID NO: 163657
  derived and/or modified sequence opt4 from hemagglutinin__InfluenzaA__AHL80828

SEQ ID NO: 163659 - RNA, 1701 nt, Artificial Sequence
  derived and/or modified sequence opt4 from hemagglutinin__InfluenzaA__AHL80839
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcaucaccgccgccugcccccacgccggcgccaagagcuucuacaagaaccugaucuggcuggugaagaagggcaacagcuaccccaagcugagcagaagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163660 - RNA, 1701 nt, Artificial Sequence
  derived and/or modified sequence opt4 from hemagglutinin__InfluenzaA__AHL80861
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucggcaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163661 - RNA, 1701 nt, Artificial Sequence
  derived and/or modified sequence opt4 from hemagglutinin__InfluenzaA__AHL80872
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaacgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163662 - RNA, 1701 nt, Artificial Sequence; identical to SEQ ID NO: 156353
  derived and/or modified sequence opt4 from hemagglutinin__InfluenzaA__AHL80883

SEQ ID NO: 163663 - RNA, 1701 nt, Artificial Sequence; identical to SEQ ID NO: 156353
  derived and/or modified sequence opt4 from hemagglutinin__InfluenzaA__AHL80894

SEQ ID NO: 163664 - RNA, 1701 nt, Artificial Sequence; identical to SEQ ID NO: 156353
  derived and/or modified sequence opt4 from hemagglutinin__InfluenzaA__AHL80905

SEQ ID NO: 163665 - RNA, 1701 nt, Artificial Sequence; identical to SEQ ID NO: 158974
  derived and/or modified sequence opt4 from hemagglutinin__InfluenzaA__AHL80916

SEQ ID NO: 163666 - RNA, 1701 nt, Artificial Sequence; identical to SEQ ID NO: 159375
  derived and/or modified sequence opt4 from hemagglutinin__InfluenzaA__AHL80927

SEQ ID NO: 163667 - RNA, 1701 nt, Artificial Sequence; identical to SEQ ID NO: 159375
  derived and/or modified sequence opt4 from hemagglutinin__InfluenzaA__AHL80946

SEQ ID NO: 163668 - RNA, 1701 nt, Artificial Sequence
  derived and/or modified sequence opt4 from hemagglutinin__InfluenzaA__AHL80958
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaucagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacaccagcgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163669 - RNA, 1701 nt, Artificial Sequence
  derived and/or modified sequence opt4 from hemagglutinin__InfluenzaA__AHL81001
augaagaccaucaucgcccugagcuacauccugugccugaucuucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163670 - RNA, 1701 nt, Artificial Sequence; identical to SEQ ID NO: 159375
  derived and/or modified sequence opt4 from hemagglutinin__InfluenzaA__AHL81013

SEQ ID NO: 163671 - RNA, 1701 nt, Artificial Sequence; identical to SEQ ID NO: 159375
  derived and/or modified sequence opt4 from hemagglutinin__InfluenzaA__AHL81025

SEQ ID NO: 163672 - RNA, 1701 nt, Artificial Sequence; identical to SEQ ID NO: 159375
  derived and/or modified sequence opt4 from hemagglutinin__InfluenzaA__AHL81037

SEQ ID NO: 163673 - RNA, 1701 nt, Artificial Sequence; identical to SEQ ID NO: 159375
  derived and/or modified sequence opt4 from hemagglutinin__InfluenzaA__AHL81049

SEQ ID NO: 163674 - RNA, 1701 nt, Artificial Sequence; identical to SEQ ID NO: 163668
  derived and/or modified sequence opt4 from hemagglutinin__InfluenzaA__AHL81061

SEQ ID NO: 163675 - RNA, 1701 nt, Artificial Sequence; identical to SEQ ID NO: 163668
  derived and/or modified sequence opt4 from hemagglutinin__InfluenzaA__AHL81072

SEQ ID NO: 163676 - RNA, 1701 nt, Artificial Sequence; identical to SEQ ID NO: 160881
  derived and/or modified sequence opt4 from hemagglutinin__InfluenzaA__AHL81083

SEQ ID NO: 163677 - RNA, 1701 nt, Artificial Sequence; identical to SEQ ID NO: 159375
  derived and/or modified sequence opt4 from hemagglutinin__InfluenzaA__AHL81095

SEQ ID NO: 163678 - RNA, 1701 nt, Artificial Sequence
  derived and/or modified sequence opt4 from hemagglutinin__InfluenzaA__AHL81118
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccaacagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163679 - RNA, 1701 nt, Artificial Sequence; identical to SEQ ID NO: 159375
  derived and/or modified sequence opt4 from hemagglutinin__InfluenzaA__AHL81129

SEQ ID NO: 163680 - RNA, 1701 nt, Artificial Sequence; identical to SEQ ID NO: 159375
  derived and/or modified sequence opt4 from hemagglutinin__InfluenzaA__AHL81141

SEQ ID NO: 163681 - RNA, 1701 nt, Artificial Sequence; identical to SEQ ID NO: 159375
  derived and/or modified sequence opt4 from hemagglutinin__InfluenzaA__AHL81153

SEQ ID NO: 163682 - RNA, 1701 nt, Artificial Sequence
  derived and/or modified sequence opt4 from hemagglutinin__InfluenzaA__AHL81165
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcgccggcgagaucugcgacagcccccaccagauccuggacggcgagaacugcacccugaucgacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163683 - RNA, 1701 nt, Artificial Sequence; identical to SEQ ID NO: 163682
  derived and/or modified sequence opt4 from hemagglutinin__InfluenzaA__AHL81177

SEQ ID NO: 163684 - RNA, 1701 nt, Artificial Sequence; identical to SEQ ID NO: 163669
  derived and/or modified sequence opt4 from hemagglutinin__InfluenzaA__AHL81189

SEQ ID NO: 163685 - RNA, 1701 nt, Artificial Sequence
  derived and/or modified sequence opt4 from hemagglutinin__InfluenzaA__AHL81212
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaagaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163686 - RNA, 1701 nt, Artificial Sequence
  derived and/or modified sequence opt4 from hemagglutinin__InfluenzaA__AHL81224
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaccgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163687 - RNA, 1701 nt, Artificial Sequence; identical to SEQ ID NO: 159375
  derived and/or modified sequence opt4 from hemagglutinin__InfluenzaA__AHL81235

SEQ ID NO: 163688 - RNA, 1701 nt, Artificial Sequence; identical to SEQ ID NO: 159375
  derived and/or modified sequence opt4 from hemagglutinin__InfluenzaA__AHL81247

SEQ ID NO: 163689 - RNA, 1701 nt, Artificial Sequence; identical to SEQ ID NO: 159375
  derived and/or modified sequence opt4 from hemagglutinin__InfluenzaA__AHL81259

SEQ ID NO: 163690 - RNA, 1701 nt, Artificial Sequence; identical to SEQ ID NO: 159375
  derived and/or modified sequence opt4 from hemagglutinin__InfluenzaA__AHL81271

SEQ ID NO: 163691 - RNA, 1701 nt, Artificial Sequence; identical to SEQ ID NO: 159375
  derived and/or modified sequence opt4 from hemagglutinin__InfluenzaA__AHL81283

SEQ ID NO: 163692 - RNA, 1701 nt, Artificial Sequence; identical to SEQ ID NO: 159375
  derived and/or modified sequence opt4 from hemagglutinin__InfluenzaA__AHL81295

SEQ ID NO: 163693 - RNA, 1701 nt, Artificial Sequence; identical to SEQ ID NO: 163668
  derived and/or modified sequence opt4 from hemagglutinin__InfluenzaA__AHL81307

SEQ ID NO: 163694 - RNA, 1701 nt, Artificial Sequence; identical to SEQ ID NO: 159387
  derived and/or modified sequence opt4 from hemagglutinin__InfluenzaA__AHL81329

SEQ ID NO: 163695 - RNA, 1701 nt, Artificial Sequence
  derived and/or modified sequence opt4 from hemagglutinin__InfluenzaA__AHL81340
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccaggacggcaccagcagcgccugcaucagaggcagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaagagauuccagaucaagggcaucgagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163696 - RNA, 1701 nt, Artificial Sequence; identical to SEQ ID NO: 159375
  derived and/or modified sequence opt4 from hemagglutinin__InfluenzaA__AHL81352

SEQ ID NO: 163697 - RNA, 1701 nt, Artificial Sequence
  derived and/or modified sequence opt4 from hemagglutinin__InfluenzaA__AHL81364
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcgccugcuaccccggcgacuucaucaacuacgaggagcugagagagcagcugagcagcgugagcagcuucgagagauucgagaucuuccccaagaccaacagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163698 - RNA, 1701 nt, Artificial Sequence
  derived and/or modified sequence opt4 from hemagglutinin__InfluenzaA__AHL81386
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccaacagcuggcccaaccacgacagcaacaagggcgugaccgccgccugcccccacgccggcgugaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163699 - RNA, 1701 nt, Artificial Sequence; identical to SEQ ID NO: 159375
  derived and/or modified sequence opt4 from hemagglutinin__InfluenzaA__AHL81397

SEQ ID NO: 163700 - RNA, 1701 nt, Artificial Sequence; identical to SEQ ID NO: 163685
  derived and/or modified sequence opt4 from hemagglutinin__InfluenzaA__AHL81409

SEQ ID NO: 163701 - RNA, 1701 nt, Artificial Sequence; identical to SEQ ID NO: 163655
  derived and/or modified sequence opt4 from hemagglutinin__InfluenzaA__AHL81419

SEQ ID NO: 163702 - RNA, 1701 nt, Artificial Sequence; identical to SEQ ID NO: 156353
  derived and/or modified sequence opt4 from hemagglutinin__InfluenzaA__AHL81430

SEQ ID NO: 163703 - RNA, 1701 nt, Artificial Sequence; identical to SEQ ID NO: 153150
  derived and/or modified sequence opt4 from hemagglutinin__InfluenzaA__AHL88951

SEQ ID NO: 163704 - RNA, 1701 nt, Artificial Sequence; identical to SEQ ID NO: 153150
  derived and/or modified sequence opt4 from hemagglutinin__InfluenzaA__AHL89030

SEQ ID NO: 163705 - RNA, 1701 nt, Artificial Sequence
  derived and/or modified sequence opt4 from hemagglutinin__InfluenzaA__AHL89042
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagaacuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccuggugggcuucaucaugugggccugccagaagggcaacaucagaugcaacaucugcaucuga

SEQ ID NO: 163706 - RNA, 1701 nt, Artificial Sequence
  derived and/or modified sequence opt4 from hemagglutinin__InfluenzaA__AHL89054
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaugagcugcuuccugcugugcguggcccugcugggcuucaucaugugggccugccagaagggcaacaucagaugcaacaucugcaucuga

SEQ ID NO: 163707 - RNA, 1701 nt, Artificial Sequence; identical to SEQ ID NO: 154101
  derived and/or modified sequence opt4 from hemagglutinin__InfluenzaA__AHL89066

SEQ ID NO: 163708 - RNA, 1701 nt, Artificial Sequence
  derived and/or modified sequence opt4 from hemagglutinin__InfluenzaA__AHL89078
augaagaccaucaucgcccugagcuacauccugugccugguguucgcccagaagcugcccggcgacgacaacagcaccgccacccugugccugggccaccacgccgugcccaacggcaccguggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163709 - RNA, 1701 nt, Artificial Sequence
  derived and/or modified sequence opt4 from hemagglutinin__InfluenzaA__AHL89090
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagccccuaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163710 - RNA, 1701 nt, Artificial Sequence; identical to SEQ ID NO: 153150
  derived and/or modified sequence opt4 from hemagglutinin__InfluenzaA__AHL89102

SEQ ID NO: 163711 - RNA, 1701 nt, Artificial Sequence; identical to SEQ ID NO: 153150
  derived and/or modified sequence opt4 from hemagglutinin__InfluenzaA__AHL89114

SEQ ID NO: 163712 - RNA, 1701 nt, Artificial Sequence
  derived and/or modified sequence opt4 from hemagglutinin__InfluenzaA__AHL89126
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagaacuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163713 - RNA, 1701 nt, Artificial Sequence
  derived and/or modified sequence opt4 from hemagglutinin__InfluenzaA__AHL89138
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccagagcagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163714 - RNA, 1701 nt, Artificial Sequence
  derived and/or modified sequence opt4 from hemagglutinin__InfluenzaA__AHL89150
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugguguucaucaugugggccugccagaagggcaacaucagaugcaacaucugcaucuga

SEQ ID NO: 163715 - RNA, 1701 nt, Artificial Sequence
  derived and/or modified sequence opt4 from hemagglutinin__InfluenzaA__AHL89162
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaccaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163716 - RNA, 1701 nt, Artificial Sequence
  derived and/or modified sequence opt4 from hemagglutinin__InfluenzaA__AHL89174
augaagaccaucaucgcccugagcuacacccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163717 - RNA, 1701 nt, Artificial Sequence
  derived and/or modified sequence opt4 from hemagglutinin__InfluenzaA__AHL89210
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163718 - RNA, 1701 nt, Artificial Sequence; identical to SEQ ID NO: 163717
  derived and/or modified sequence opt4 from hemagglutinin__InfluenzaA__AHL89222

SEQ ID NO: 163719 - RNA, 1701 nt, Artificial Sequence
  derived and/or modified sequence opt4 from hemagglutinin__InfluenzaA__AHL89234
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaugggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163720 - RNA, 1701 nt, Artificial Sequence
  derived and/or modified sequence opt4 from hemagglutinin__InfluenzaA__AHL89246
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcggcaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163721 - RNA, 1701 nt, Artificial Sequence
  derived and/or modified sequence opt4 from hemagglutinin__InfluenzaA__AHL89258
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccaggcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 163722 - RNA, 1701 nt, Artificial Sequence; identical to SEQ ID NO: 163717
  derived and/or modified sequence opt4 from hemagglutinin__InfluenzaA__AHL89270

SEQ ID NO: 163723 - RNA, 1701 nt, Artificial Sequence; identical to SEQ ID NO: 163717
  derived and/or modified sequence opt4 from hemagglutinin__InfluenzaA__AHL89282

SEQ ID NO: 163724 - RNA, 1701 nt, Artificial Sequence; identical to SEQ ID NO: 163717
  derived and/or modified sequence opt4 from hemagglutinin__InfluenzaA__AHL89294

SEQ ID NO: 163725 - RNA, 1701 nt, Artificial Sequence; identical to SEQ ID NO: 163717
  derived and/or modified sequence opt4 from hemagglutinin__InfluenzaA__AHL89306

SEQ ID NO: 163726 - RNA, 1701 nt, Artificial Sequence; identical to SEQ ID NO: 154101
  derived and/or modified sequence opt4 from hemagglutinin__InfluenzaA__AHL89318

SEQ ID NO: 163727 - RNA, 1701 nt, Artificial Sequence
  derived and/or modified sequence opt4 from hemagglutinin__InfluenzaA__AHL89330
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163728 - RNA, 1701 nt, Artificial Sequence; identical to SEQ ID NO: 153150
  derived and/or modified sequence opt4 from hemagglutinin__InfluenzaA__AHL89342

SEQ ID NO: 163729 - RNA, 1701 nt, Artificial Sequence; identical to SEQ ID NO: 154081
  derived and/or modified sequence opt4 from hemagglutinin__InfluenzaA__AHL89354

SEQ ID NO: 163730 - RNA, 1701 nt, Artificial Sequence
  derived and/or modified sequence opt4 from hemagglutinin__InfluenzaA__AHL89366
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugaagagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcaucgagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 163731 - RNA, 1701 nt, Artificial Sequence; identical to SEQ ID NO: 163717
  derived and/or modified sequence opt4 from hemagglutinin__InfluenzaA__AHL89378

SEQ ID NO: 163732 - RNA, 1701 nt, Artificial Sequence; identical to SEQ ID NO: 154348
  derived and/or modified sequence opt4 from hemagglutinin__InfluenzaA__AHL89390

SEQ ID NO: 163733 - RNA, 1701 nt, Artificial Sequence; identical to SEQ ID NO: 163717
  derived and/or modified sequence opt4 from hemagglutinin__InfluenzaA__AHL89402

SEQ ID NO: 163734 - RNA, 1701 nt, Artificial Sequence; identical to SEQ ID NO: 154101
  derived and/or modified sequence opt4 from hemagglutinin__InfluenzaA__AHL89414

SEQ ID NO: 163735 - RNA, 1701 nt, Artificial Sequence
  derived and/or modified sequence opt4 from hemagglutinin__InfluenzaA__AHL89426
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccuguucaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 163736 - RNA, 1701 nt, Artificial Sequence; identical to SEQ ID NO: 163717
  derived and/or modified sequence opt4 from hemagglutinin__InfluenzaA__AHL89438

SEQ ID NO: 163737 - RNA, 1701 nt, Artificial Sequence; identical to SEQ ID NO: 163717
  derived and/or modified sequence opt4 from hemagglutinin__InfluenzaA__AHL89450

SEQ ID NO: 163738 - RNA, 1701 nt, Artificial Sequence; identical to SEQ ID NO: 163717
  derived and/or modified sequence opt4 from hemagglutinin__InfluenzaA__AHL89462

SEQ ID NO: 163739 - RNA, 1701 nt, Artificial Sequence; identical to SEQ ID NO: 163717
  derived and/or modified sequence opt4 from hemagglutinin__InfluenzaA__AHL89474

SEQ ID NO: 163740 - RNA, 1701 nt, Artificial Sequence; identical to SEQ ID NO: 154348
  derived and/or modified sequence opt4 from hemagglutinin__InfluenzaA__AHL89486

SEQ ID NO: 163741 - RNA, 1701 nt, Artificial Sequence; identical to SEQ ID NO: 154101
  derived and/or modified sequence opt4 from hemagglutinin__InfluenzaA__AHL89498

SEQ ID NO: 163742 - RNA, 1701 nt, Artificial Sequence; identical to SEQ ID NO: 154101
  derived and/or modified sequence opt4 from hemagglutinin__InfluenzaA__AHL89510

SEQ ID NO: 163743 - RNA, 1701 nt, Artificial Sequence; identical to SEQ ID NO: 154101
  derived and/or modified sequence opt4 from hemagglutinin__InfluenzaA__AHL89522

SEQ ID NO: 163744 - RNA, 1701 nt, Artificial Sequence
  derived and/or modified sequence opt4 from hemagglutinin__InfluenzaA__AHL89534
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcaucgagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 163745 - RNA, 1698 nt, Artificial Sequence
  derived and/or modified sequence opt4 from hemagglutinin__InfluenzaA__AHL89546
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagagcgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagagaaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 163746 - RNA, 1698 nt, Artificial Sequence; identical to SEQ ID NO: 154434
  derived and/or modified sequence opt4 from hemagglutinin__InfluenzaA__AHL89558

SEQ ID NO: 163747 - RNA, 1698 nt, Artificial Sequence; identical to SEQ ID NO: 154434
  derived and/or modified sequence opt4 from hemagglutinin__InfluenzaA__AHL89570

SEQ ID NO: 163748 - RNA, 1698 nt, Artificial Sequence; identical to SEQ ID NO: 154450
  derived and/or modified sequence opt4 from hemagglutinin__InfluenzaA__AHL89582

SEQ ID NO: 163749 - RNA, 1698 nt, Artificial Sequence; identical to SEQ ID NO: 154450
  derived and/or modified sequence opt4 from hemagglutinin__InfluenzaA__AHL89594

SEQ ID NO: 163750 - RNA, 1698 nt, Artificial Sequence; identical to SEQ ID NO: 154450
  derived and/or modified sequence opt4 from hemagglutinin__InfluenzaA__AHL89606

SEQ ID NO: 163751 - RNA, 1698 nt, Artificial Sequence; identical to SEQ ID NO: 154434
  derived and/or modified sequence opt4 from hemagglutinin__InfluenzaA__AHL89618

SEQ ID NO: 163752 - RNA, 1698 nt, Artificial Sequence; identical to SEQ ID NO: 154450
  derived and/or modified sequence opt4 from hemagglutinin__InfluenzaA__AHL89630

SEQ ID NO: 163753 - RNA, 1698 nt, Artificial Sequence
  derived and/or modified sequence opt4 from hemagglutinin__InfluenzaA__AHL89642
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacaaccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 163754 - RNA, 1698 nt, Artificial Sequence; identical to SEQ ID NO: 154465
  derived and/or modified sequence opt4 from hemagglutinin__InfluenzaA__AHL89654

SEQ ID NO: 163755 - RNA, 1698 nt, Artificial Sequence
  derived and/or modified sequence opt4 from hemagglutinin__InfluenzaA__AHL89666
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacaaccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccgaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 163756 - RNA, 1698 nt, Artificial Sequence
  derived and/or modified sequence opt4 from hemagglutinin__InfluenzaA__AHL89678
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagaaagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 163757 - RNA, 1698 nt, Artificial Sequence
  derived and/or modified sequence opt4 from hemagglutinin__InfluenzaA__AHL89690
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccgaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 163758 - RNA, 1698 nt, Artificial Sequence; identical to SEQ ID NO: 154465
  derived and/or modified sequence opt4 from hemagglutinin__InfluenzaA__AHL89702

SEQ ID NO: 163759 - RNA, 1698 nt, Artificial Sequence; identical to SEQ ID NO: 154434
  derived and/or modified sequence opt4 from hemagglutinin__InfluenzaA__AHL89714

SEQ ID NO: 163760 - RNA, 1698 nt, Artificial Sequence
  derived and/or modified sequence opt4 from hemagglutinin__InfluenzaA__AHL89726
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 163761 - RNA, 1698 nt, Artificial Sequence
  derived and/or modified sequence opt4 from hemagglutinin__InfluenzaA__AHL89750
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacggcugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 163762 - RNA, 1698 nt, Artificial Sequence; identical to SEQ ID NO: 154430
  derived and/or modified sequence opt4 from hemagglutinin__InfluenzaA__AHL89762

SEQ ID NO: 163763 - RNA, 1698 nt, Artificial Sequence; identical to SEQ ID NO: 154476
  derived and/or modified sequence opt4 from hemagglutinin__InfluenzaA__AHL89774

SEQ ID NO: 163764 - RNA, 1698 nt, Artificial Sequence; identical to SEQ ID NO: 154465
  derived and/or modified sequence opt4 from hemagglutinin__InfluenzaA__AHL89786

SEQ ID NO: 163765 - RNA, 1698 nt, Artificial Sequence
  derived and/or modified sequence opt4 from hemagglutinin__InfluenzaA__AHL89798
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagacacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcagaagcuacgccaacaacaaggagaaggaggugcuggugcuguggggcgugcaccacccccccagcaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 163766 - RNA, 1698 nt, Artificial Sequence
  derived and/or modified sequence opt4 from hemagglutinin__InfluenzaA__AHL89810
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccaugggcgagugcgacgccgagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 163767 - RNA, 1698 nt, Artificial Sequence
  derived and/or modified sequence opt4 from hemagglutinin__InfluenzaA__AHL89822
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagacacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 163768 - RNA, 1698 nt, Artificial Sequence
  derived and/or modified sequence opt4 from hemagglutinin__InfluenzaA__AHL89834
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcaacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcgacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 163769 - RNA, 1698 nt, Artificial Sequence; identical to SEQ ID NO: 154476
  derived and/or modified sequence opt4 from hemagglutinin__InfluenzaA__AHL89846

SEQ ID NO: 163770 - RNA, 1701 nt, Artificial Sequence; identical to SEQ ID NO: 154448
  derived and/or modified sequence opt4 from hemagglutinin__InfluenzaA__AHL89858

SEQ ID NO: 163771 - RNA, 1701 nt, Artificial Sequence; identical to SEQ ID NO: 154448
  derived and/or modified sequence opt4 from hemagglutinin__InfluenzaA__AHL89870

SEQ ID NO: 163772 - RNA, 1701 nt, Artificial Sequence
  derived and/or modified sequence opt4 from hemagglutinin__InfluenzaA__AHL89882
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcgacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163773 - RNA, 1701 nt, Artificial Sequence; identical to SEQ ID NO: 154448
  derived and/or modified sequence opt4 from hemagglutinin__InfluenzaA__AHL89894

SEQ ID NO: 163774 - RNA, 1701 nt, Artificial Sequence
  derived and/or modified sequence opt4 from hemagglutinin__InfluenzaA__AHL89906
augaagaccaucaucgcccugagcuacauccugugccugguguacgcccagaagcugcccggcaucgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugagacagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163775 - RNA, 1701 nt, Artificial Sequence
  derived and/or modified sequence opt4 from hemagglutinin__InfluenzaA__AHL89918
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaccuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163776 - RNA, 1701 nt, Artificial Sequence
  derived and/or modified sequence opt4 from hemagglutinin__InfluenzaA__AHL89930
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucagcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaugggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163777 - RNA, 1701 nt, Artificial Sequence; identical to SEQ ID NO: 154435
  derived and/or modified sequence opt4 from hemagglutinin__InfluenzaA__AHL89942

SEQ ID NO: 163778 - RNA, 1701 nt, Artificial Sequence
  derived and/or modified sequence opt4 from hemagglutinin__InfluenzaA__AHL89954
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163779 - RNA, 1701 nt, Artificial Sequence; identical to SEQ ID NO: 154448
  derived and/or modified sequence opt4 from hemagglutinin__InfluenzaA__AHL89966

SEQ ID NO: 163780 - RNA, 1701 nt, Artificial Sequence; identical to SEQ ID NO: 154448
  derived and/or modified sequence opt4 from hemagglutinin__InfluenzaA__AHL89978

SEQ ID NO: 163781 - RNA, 1701 nt, Artificial Sequence; identical to SEQ ID NO: 154507
  derived and/or modified sequence opt4 from hemagglutinin__InfluenzaA__AHL89990

SEQ ID NO: 163782 - RNA, 1701 nt, Artificial Sequence
  derived and/or modified sequence opt4 from hemagglutinin__InfluenzaA__AHL90002
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaugggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163783 - RNA, 1701 nt, Artificial Sequence
  derived and/or modified sequence opt4 from hemagglutinin__InfluenzaA__AHL90014
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagguggaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163784 - RNA, 1701 nt, Artificial Sequence; identical to SEQ ID NO: 163783
  derived and/or modified sequence opt4 from hemagglutinin__InfluenzaA__AHL90026

SEQ ID NO: 163785 - RNA, 1701 nt, Artificial Sequence
  derived and/or modified sequence opt4 from hemagglutinin__InfluenzaA__AHL90050
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacgccgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163786 - RNA, 1701 nt, Artificial Sequence
  derived and/or modified sequence opt4 from hemagglutinin__InfluenzaA__AHL90062
augaagaccaucaucgcccugagcuacauccugugccugguguucgcccagaagcugcccgagaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacuacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163787 - RNA, 1701 nt, Artificial Sequence; identical to SEQ ID NO: 154448
  derived and/or modified sequence opt4 from hemagglutinin__InfluenzaA__AHL90074

SEQ ID NO: 163788 - RNA, 1701 nt, Artificial Sequence
  derived and/or modified sequence opt4 from hemagglutinin__InfluenzaA__AHL90086
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagauacaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163789 - RNA, 1701 nt, Artificial Sequence
  derived and/or modified sequence opt4 from hemagglutinin__InfluenzaA__AHL90098
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcgacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163790 - RNA, 1701 nt, Artificial Sequence
  derived and/or modified sequence opt4 from hemagglutinin__InfluenzaA__AHL90110
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagauccagagcggcaagagcagcgugaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163791 - RNA, 1698 nt, Artificial Sequence; identical to SEQ ID NO: 156615
  derived and/or modified sequence opt4 from hemagglutinin__InfluenzaA__AHL90122

SEQ ID NO: 163792 - RNA, 1698 nt, Artificial Sequence; identical to SEQ ID NO: 155008
  derived and/or modified sequence opt4 from hemagglutinin__InfluenzaA__AHL90133

SEQ ID NO: 163793 - RNA, 1698 nt, Artificial Sequence; identical to SEQ ID NO: 156615
  derived and/or modified sequence opt4 from hemagglutinin__InfluenzaA__AHL90145

SEQ ID NO: 163794 - RNA, 1698 nt, Artificial Sequence
  derived and/or modified sequence opt4 from hemagglutinin__InfluenzaA__AHL90157
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagauccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccaucgccagcagccuggugcugcuggugagccugggcgccaucagcuucuggaugugcagcaacggcagccugcagugcagaaucugcaucuga

SEQ ID NO: 163795 - RNA, 1698 nt, Artificial Sequence; identical to SEQ ID NO: 156615
  derived and/or modified sequence opt4 from hemagglutinin__InfluenzaA__AHL90169

SEQ ID NO: 163796 - RNA, 1698 nt, Artificial Sequence
  derived and/or modified sequence opt4 from hemagglutinin__InfluenzaA__AHL90181
augaaggugaagcugcuggugcugcugugcaccuucgccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccaagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 163797 - RNA, 1698 nt, Artificial Sequence; identical to SEQ ID NO: 155690
  derived and/or modified sequence opt4 from hemagglutinin__InfluenzaA__AHL90217

SEQ ID NO: 163798 - RNA, 1698 nt, Artificial Sequence; identical to SEQ ID NO: 155690
  derived and/or modified sequence opt4 from hemagglutinin__InfluenzaA__AHL90229

SEQ ID NO: 163799 - RNA, 1698 nt, Artificial Sequence
  derived and/or modified sequence opt4 from hemagglutinin__InfluenzaA__AHL90241
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugauccccaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 163800 - RNA, 1698 nt, Artificial Sequence
  derived and/or modified sequence opt4 from hemagglutinin__InfluenzaA__AHL90253
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaagggcagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggugagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 163801 - RNA, 1698 nt, Artificial Sequence; identical to SEQ ID NO: 155008
  derived and/or modified sequence opt4 from hemagglutinin__InfluenzaA__AHL90265

SEQ ID NO: 163802 - RNA, 1698 nt, Artificial Sequence
  derived and/or modified sequence opt4 from hemagglutinin__InfluenzaA__AHL90277
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 163803 - RNA, 1698 nt, Artificial Sequence
  derived and/or modified sequence opt4 from hemagglutinin__InfluenzaA__AHL90289
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccagagacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 163804 - RNA, 1698 nt, Artificial Sequence; identical to SEQ ID NO: 163803
  derived and/or modified sequence opt4 from hemagglutinin__InfluenzaA__AHL90301

SEQ ID NO: 163805 - RNA, 1698 nt, Artificial Sequence
  derived and/or modified sequence opt4 from hemagglutinin__InfluenzaA__AHL90325
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaugggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 163806 - RNA, 1698 nt, Artificial Sequence; identical to SEQ ID NO: 163805
  derived and/or modified sequence opt4 from hemagglutinin__InfluenzaA__AHL90337

SEQ ID NO: 163807 - RNA, 1698 nt, Artificial Sequence; identical to SEQ ID NO: 155008
  derived and/or modified sequence opt4 from hemagglutinin__InfluenzaA__AHL90349

SEQ ID NO: 163808 - RNA, 1698 nt, Artificial Sequence; identical to SEQ ID NO: 155008
  derived and/or modified sequence opt4 from hemagglutinin__InfluenzaA__AHL90361

SEQ ID NO: 163809 - RNA, 1698 nt, Artificial Sequence; identical to SEQ ID NO: 163802
  derived and/or modified sequence opt4 from hemagglutinin__InfluenzaA__AHL90373

SEQ ID NO: 163810 - RNA, 1701 nt, Artificial Sequence
  derived and/or modified sequence opt4 from hemagglutinin__InfluenzaA__AHL90385
augaagaccaucaucgcccugagcuacauccagugccugguguucgcccagaaguuccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaacugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgagaacuucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcagaaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgcccugcugggcuucaucaugugggccugccagaagggcaacaucagaugcaacaucugcaucuga

SEQ ID NO: 163811 - RNA, 1701 nt, Artificial Sequence
  derived and/or modified sequence opt4 from hemagglutinin__InfluenzaA__AHL90397
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163812 - RNA, 1701 nt, Artificial Sequence; identical to SEQ ID NO: 154954
  derived and/or modified sequence opt4 from hemagglutinin__InfluenzaA__AHL90410

SEQ ID NO: 163813 - RNA, 1701 nt, Artificial Sequence
  derived and/or modified sequence opt4 from hemagglutinin__InfluenzaA__AHL90422
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugagcaagcuguucgagaagaccaagaagcagcugagagagaacgccgaggacaugggcaacggcugcuucaagaucuaccacaagugcgacaacaccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163814 - RNA, 1701 nt, Artificial Sequence; identical to SEQ ID NO: 154954
  derived and/or modified sequence opt4 from hemagglutinin__InfluenzaA__AHL90434

SEQ ID NO: 163815 - RNA, 1701 nt, Artificial Sequence; identical to SEQ ID NO: 154954
  derived and/or modified sequence opt4 from hemagglutinin__InfluenzaA__AHL90446

SEQ ID NO: 163816 - RNA, 1701 nt, Artificial Sequence
  derived and/or modified sequence opt4 from hemagglutinin__InfluenzaA__AHL90458
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcgcccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163817 - RNA, 1701 nt, Artificial Sequence; identical to SEQ ID NO: 154954
  derived and/or modified sequence opt4 from hemagglutinin__InfluenzaA__AHL90470

SEQ ID NO: 163818 - RNA, 1701 nt, Artificial Sequence; identical to SEQ ID NO: 154954
  derived and/or modified sequence opt4 from hemagglutinin__InfluenzaA__AHL90482

SEQ ID NO: 163819 - RNA, 1701 nt, Artificial Sequence; identical to SEQ ID NO: 155057
  derived and/or modified sequence opt4 from hemagglutinin__InfluenzaA__AHL90494

SEQ ID NO: 163820 - RNA, 1701 nt, Artificial Sequence; identical to SEQ ID NO: 155057
  derived and/or modified sequence opt4 from hemagglutinin__InfluenzaA__AHL90506

SEQ ID NO: 163821 - RNA, 1701 nt, Artificial Sequence
  derived and/or modified sequence opt4 from hemagglutinin__InfluenzaA__AHL90518
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaagaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaaggagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163822 - RNA, 1701 nt, Artificial Sequence; identical to SEQ ID NO: 155733
  derived and/or modified sequence opt4 from hemagglutinin__InfluenzaA__AHL90530

SEQ ID NO: 163823 - RNA, 1701 nt, Artificial Sequence; identical to SEQ ID NO: 154954
  derived and/or modified sequence opt4 from hemagglutinin__InfluenzaA__AHL90542

SEQ ID NO: 163824 - RNA, 1701 nt, Artificial Sequence; identical to SEQ ID NO: 154954
  derived and/or modified sequence opt4 from hemagglutinin__InfluenzaA__AHL90554

SEQ ID NO: 163825 - RNA, 1701 nt, Artificial Sequence; identical to SEQ ID NO: 154954
  derived and/or modified sequence opt4 from hemagglutinin__InfluenzaA__AHL90566

SEQ ID NO: 163826 - RNA, 1701 nt, Artificial Sequence; identical to SEQ ID NO: 154954
  derived and/or modified sequence opt4 from hemagglutinin__InfluenzaA__AHL90578

SEQ ID NO: 163827 - RNA, 1701 nt, Artificial Sequence; identical to SEQ ID NO: 155057
  derived and/or modified sequence opt4 from hemagglutinin__InfluenzaA__AHL90590

SEQ ID NO: 163828 - RNA, 1701 nt, Artificial Sequence; identical to SEQ ID NO: 154954
  derived and/or modified sequence opt4 from hemagglutinin__InfluenzaA__AHL90602

SEQ ID NO: 163829 - RNA, 1701 nt, Artificial Sequence; identical to SEQ ID NO: 154954
  derived and/or modified sequence opt4 from hemagglutinin__InfluenzaA__AHL90614

SEQ ID NO: 163830 - RNA, 1701 nt, Artificial Sequence
  derived and/or modified sequence opt4 from hemagglutinin__InfluenzaA__AHL90638
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcagaaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163831 - RNA, 1701 nt, Artificial Sequence
  derived and/or modified sequence opt4 from hemagglutinin__InfluenzaA__AHL90650
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaccuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163832 - RNA, 1701 nt, Artificial Sequence; identical to SEQ ID NO: 154954
  derived and/or modified sequence opt4 from hemagglutinin__InfluenzaA__AHL90662

SEQ ID NO: 163833 - RNA, 1701 nt, Artificial Sequence
  derived and/or modified sequence opt4 from hemagglutinin__InfluenzaA__AHL90674
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgugugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163834 - RNA, 1701 nt, Artificial Sequence
  derived and/or modified sequence opt4 from hemagglutinin__InfluenzaA__AHL90686
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggccauggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163835 - RNA, 1701 nt, Artificial Sequence; identical to SEQ ID NO: 154954
  derived and/or modified sequence opt4 from hemagglutinin__InfluenzaA__AHL90698

SEQ ID NO: 163836 - RNA, 1701 nt, Artificial Sequence; identical to SEQ ID NO: 154954
  derived and/or modified sequence opt4 from hemagglutinin__InfluenzaA__AHL90710

SEQ ID NO: 163837 - RNA, 1698 nt, Artificial Sequence; identical to SEQ ID NO: 158492
  derived and/or modified sequence opt4 from hemagglutinin__InfluenzaA__AHL90722

SEQ ID NO: 163838 - RNA, 1698 nt, Artificial Sequence
  derived and/or modified sequence opt4 from hemagglutinin__InfluenzaA__AHL90746
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucaagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccaugggcaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 163839 - RNA, 1698 nt, Artificial Sequence; identical to SEQ ID NO: 155651
  derived and/or modified sequence opt4 from hemagglutinin__InfluenzaA__AHL90758

SEQ ID NO: 163840 - RNA, 1698 nt, Artificial Sequence
  derived and/or modified sequence opt4 from hemagglutinin__InfluenzaA__AHL90770
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggacagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccagcaucaacgaccagaagacccuguaccacaccgagaacgccuacgugagcguggugagcagccaccacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccugaccaucuacagcaccguggccagcagccuggugcugcuggugagccugggcgccaucagcuucuggaugugcagcaacggcagccugcagugcagaaucugcaucuga

SEQ ID NO: 163841 - RNA, 1698 nt, Artificial Sequence; identical to SEQ ID NO: 156136
  derived and/or modified sequence opt4 from hemagglutinin__InfluenzaA__AHL90782

SEQ ID NO: 163842 - RNA, 1698 nt, Artificial Sequence
  derived and/or modified sequence opt4 from hemagglutinin__InfluenzaA__AHL90794
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaacacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 163843 - RNA, 1698 nt, Artificial Sequence
  derived and/or modified sequence opt4 from hemagglutinin__InfluenzaA__AHL90806
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcugaucagccugggcgccaucagcuucuggaugugcagcaacggcagccugcagugcagaaucugcaucuga

SEQ ID NO: 163844 - RNA, 1698 nt, Artificial Sequence; identical to SEQ ID NO: 158492
  derived and/or modified sequence opt4 from hemagglutinin__InfluenzaA__AHL90818

SEQ ID NO: 163845 - RNA, 1698 nt, Artificial Sequence; identical to SEQ ID NO: 158492
  derived and/or modified sequence opt4 from hemagglutinin__InfluenzaA__AHL90830

SEQ ID NO: 163846 - RNA, 1698 nt, Artificial Sequence; identical to SEQ ID NO: 155651
  derived and/or modified sequence opt4 from hemagglutinin__InfluenzaA__AHL90842

SEQ ID NO: 163847 - RNA, 1698 nt, Artificial Sequence; identical to SEQ ID NO: 158033
  derived and/or modified sequence opt4 from hemagglutinin__InfluenzaA__AHL90854

SEQ ID NO: 163848 - RNA, 1698 nt, Artificial Sequence; identical to SEQ ID NO: 155651
  derived and/or modified sequence opt4 from hemagglutinin__InfluenzaA__AHL90866

SEQ ID NO: 163849 - RNA, 1698 nt, Artificial Sequence; identical to SEQ ID NO: 158033
  derived and/or modified sequence opt4 from hemagglutinin__InfluenzaA__AHL90878

SEQ ID NO: 163850 - RNA, 1698 nt, Artificial Sequence; identical to SEQ ID NO: 158492
  derived and/or modified sequence opt4 from hemagglutinin__InfluenzaA__AHL90890

SEQ ID NO: 163851 - RNA, 1698 nt, Artificial Sequence; identical to SEQ ID NO: 158033
  derived and/or modified sequence opt4 from hemagglutinin__InfluenzaA__AHL90902

SEQ ID NO: 163852 - RNA, 1698 nt, Artificial Sequence; identical to SEQ ID NO: 155651
  derived and/or modified sequence opt4 from hemagglutinin__InfluenzaA__AHL90914

SEQ ID NO: 163853 - RNA, 1698 nt, Artificial Sequence; identical to SEQ ID NO: 158033
  derived and/or modified sequence opt4 from hemagglutinin__InfluenzaA__AHL90938

SEQ ID NO: 163854 - RNA, 1698 nt, Artificial Sequence; identical to SEQ ID NO: 158033
  derived and/or modified sequence opt4 from hemagglutinin__InfluenzaA__AHL90950

SEQ ID NO: 163855 - RNA, 1698 nt, Artificial Sequence; identical to SEQ ID NO: 158033
  derived and/or modified sequence opt4 from hemagglutinin__InfluenzaA__AHL90962

SEQ ID NO: 163856 - RNA, 1698 nt, Artificial Sequence
  derived and/or modified sequence opt4 from hemagglutinin__InfluenzaA__AHL90974
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccagcaucagcgaccagaagacccuguaccacaccgagaacgccuacgugagcguggugagcagccacuacagcagaaaguucacccccgagguggccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagggccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 163857 - RNA, 1698 nt, Artificial Sequence
  derived and/or modified sequence opt4 from hemagglutinin__InfluenzaA__AHL90986
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccgugaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcaagggcuucggcagcggcaucaucaacagcaacgcccccauggacaagugcgacgccaagugccagacccccagaggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 163858 - RNA, 1698 nt, Artificial Sequence
  derived and/or modified sequence opt4 from hemagglutinin__InfluenzaA__AHL91010
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggacagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccagcaucaacgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccugaccaucuacagcaccguggccagcagccuggugcugcuggugagccugggcgccaucagcuucuggaugugcagcaacggcagccugcagugcagaaucugcaucuga

SEQ ID NO: 163859 - RNA, 1698 nt, Artificial Sequence
  derived and/or modified sequence opt4 from hemagglutinin__InfluenzaA__AHL91022
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggacagcagcuggcccaaccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccagcaucaacgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccugaccaucuacagcaccguggccagcagccuggugcugcuggugagccugggcgccaucagcuucuggaugugcagcaacggcagccugcagugcagaaucugcaucuga

SEQ ID NO: 163860 - RNA, 1701 nt, Artificial Sequence; identical to SEQ ID NO: 154954
  derived and/or modified sequence opt4 from hemagglutinin__InfluenzaA__AHL91034

SEQ ID NO: 163861 - RNA, 1701 nt, Artificial Sequence; identical to SEQ ID NO: 158020
  derived and/or modified sequence opt4 from hemagglutinin__InfluenzaA__AHL91046

SEQ ID NO: 163862 - RNA, 1701 nt, Artificial Sequence; identical to SEQ ID NO: 163834
  derived and/or modified sequence opt4 from hemagglutinin__InfluenzaA__AHL91058

SEQ ID NO: 163863 - RNA, 1701 nt, Artificial Sequence
  derived and/or modified sequence opt4 from hemagglutinin__InfluenzaA__AHL91070
augaagaccaucaucgcccugagcuacauccugugccugguguucgcccagaagcugcccggcaacgacaacagcauggccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaugagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163864 - RNA, 1701 nt, Artificial Sequence
  derived and/or modified sequence opt4 from hemagglutinin__InfluenzaA__AHL91082
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccaucuacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163865 - RNA, 1701 nt, Artificial Sequence; identical to SEQ ID NO: 157939
  derived and/or modified sequence opt4 from hemagglutinin__InfluenzaA__AHL91094

SEQ ID NO: 163866 - RNA, 1701 nt, Artificial Sequence
  derived and/or modified sequence opt4 from hemagglutinin__InfluenzaA__AHL91106
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaagggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163867 - RNA, 1701 nt, Artificial Sequence
  derived and/or modified sequence opt4 from hemagglutinin__InfluenzaA__AHL91118
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcaagcugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcuggugacccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163868 - RNA, 1701 nt, Artificial Sequence
  derived and/or modified sequence opt4 from hemagglutinin__InfluenzaA__AHL91130
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163869 - RNA, 1701 nt, Artificial Sequence; identical to SEQ ID NO: 154954
  derived and/or modified sequence opt4 from hemagglutinin__InfluenzaA__AHL91142

SEQ ID NO: 163870 - RNA, 1701 nt, Artificial Sequence; identical to SEQ ID NO: 154954
  derived and/or modified sequence opt4 from hemagglutinin__InfluenzaA__AHL91154

SEQ ID NO: 163871 - RNA, 1701 nt, Artificial Sequence; identical to SEQ ID NO: 153150
  derived and/or modified sequence opt4 from hemagglutinin__InfluenzaA__AHL91166

SEQ ID NO: 163872 - RNA, 1701 nt, Artificial Sequence; identical to SEQ ID NO: 162987
  derived and/or modified sequence opt4 from hemagglutinin__InfluenzaA__AHL94984

SEQ ID NO: 163873 - RNA, 1701 nt, Artificial Sequence; identical to SEQ ID NO: 162987
  derived and/or modified sequence opt4 from hemagglutinin__InfluenzaA__AHL94996

SEQ ID NO: 163874 - RNA, 1701 nt, Artificial Sequence; identical to SEQ ID NO: 162355
  derived and/or modified sequence opt4 from hemagglutinin__InfluenzaA__AHL95008

SEQ ID NO: 163875 - RNA, 1701 nt, Artificial Sequence; identical to SEQ ID NO: 162517
  derived and/or modified sequence opt4 from hemagglutinin__InfluenzaA__AHL95020

SEQ ID NO: 163876 - RNA, 1701 nt, Artificial Sequence; identical to SEQ ID NO: 162514
  derived and/or modified sequence opt4 from hemagglutinin__InfluenzaA__AHL95032

SEQ ID NO: 163877 - RNA, 1701 nt, Artificial Sequence; identical to SEQ ID NO: 162388
  derived and/or modified sequence opt4 from hemagglutinin__InfluenzaA__AHL95044

SEQ ID NO: 163878 - RNA, 1701 nt, Artificial Sequence; identical to SEQ ID NO: 162378
  derived and/or modified sequence opt4 from hemagglutinin__InfluenzaA__AHL95056

SEQ ID NO: 163879 - RNA, 1701 nt, Artificial Sequence; identical to SEQ ID NO: 162517
  derived and/or modified sequence opt4 from hemagglutinin__InfluenzaA__AHL95068

SEQ ID NO: 163880 - RNA, 1701 nt, Artificial Sequence; identical to SEQ ID NO: 163065
  derived and/or modified sequence opt4 from hemagglutinin__InfluenzaA__AHL95080

SEQ ID NO: 163881 - RNA, 1701 nt, Artificial Sequence; identical to SEQ ID NO: 162388
  derived and/or modified sequence opt4 from hemagglutinin__InfluenzaA__AHL95092

SEQ ID NO: 163882 - RNA, 1701 nt, Artificial Sequence
  derived and/or modified sequence opt4 from hemagglutinin__InfluenzaA__AHL95104
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaugagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163883 - RNA, 1701 nt, Artificial Sequence
  derived and/or modified sequence opt4 from hemagglutinin__InfluenzaA__AHL95116
augaagaccaucaucgcccugagcuacauccugugccugguguucgcccaggagcugcccggcaacgacgacagcaccgccacccugugccugggccacuacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgccaaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163884 - RNA, 1701 nt, Artificial Sequence; identical to SEQ ID NO: 162355
  derived and/or modified sequence opt4 from hemagglutinin__InfluenzaA__AHL95128

SEQ ID NO: 163885 - RNA, 1701 nt, Artificial Sequence; identical to SEQ ID NO: 162378
  derived and/or modified sequence opt4 from hemagglutinin__InfluenzaA__AHL95140

SEQ ID NO: 163886 - RNA, 1701 nt, Artificial Sequence; identical to SEQ ID NO: 162388
  derived and/or modified sequence opt4 from hemagglutinin__InfluenzaA__AHL95152

SEQ ID NO: 163887 - RNA, 1701 nt, Artificial Sequence; identical to SEQ ID NO: 162355
  derived and/or modified sequence opt4 from hemagglutinin__InfluenzaA__AHL95164

SEQ ID NO: 163888 - RNA, 1701 nt, Artificial Sequence; identical to SEQ ID NO: 162388
  derived and/or modified sequence opt4 from hemagglutinin__InfluenzaA__AHL95176

SEQ ID NO: 163889 - RNA, 1701 nt, Artificial Sequence; identical to SEQ ID NO: 162388
  derived and/or modified sequence opt4 from hemagglutinin__InfluenzaA__AHL95188

SEQ ID NO: 163890 - RNA, 1701 nt, Artificial Sequence; identical to SEQ ID NO: 162514
  derived and/or modified sequence opt4 from hemagglutinin__InfluenzaA__AHL95200

SEQ ID NO: 163891 - RNA, 1701 nt, Artificial Sequence; identical to SEQ ID NO: 162388
  derived and/or modified sequence opt4 from hemagglutinin__InfluenzaA__AHL95212

SEQ ID NO: 163892 - RNA, 1701 nt, Artificial Sequence; identical to SEQ ID NO: 162378
  derived and/or modified sequence opt4 from hemagglutinin__InfluenzaA__AHL95224

SEQ ID NO: 163893 - RNA, 1701 nt, Artificial Sequence; identical to SEQ ID NO: 162378
  derived and/or modified sequence opt4 from hemagglutinin__InfluenzaA__AHL95236

SEQ ID NO: 163894 - RNA, 1701 nt, Artificial Sequence; identical to SEQ ID NO: 162403
  derived and/or modified sequence opt4 from hemagglutinin__InfluenzaA__AHL95248

SEQ ID NO: 163895 - RNA, 1701 nt, Artificial Sequence
  derived and/or modified sequence opt4 from hemagglutinin__InfluenzaA__AHL95260
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucagcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163896 - RNA, 1701 nt, Artificial Sequence; identical to SEQ ID NO: 162388
  derived and/or modified sequence opt4 from hemagglutinin__InfluenzaA__AHL95272

SEQ ID NO: 163897 - RNA, 1701 nt, Artificial Sequence; identical to SEQ ID NO: 162514
  derived and/or modified sequence opt4 from hemagglutinin__InfluenzaA__AHL95284

SEQ ID NO: 163898 - RNA, 1701 nt, Artificial Sequence
  derived and/or modified sequence opt4 from hemagglutinin__InfluenzaA__AHL95296
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaaggacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 163899 - RNA, 1701 nt, Artificial Sequence; identical to SEQ ID NO: 162355
  derived and/or modified sequence opt4 from hemagglutinin__InfluenzaA__AHL95307

SEQ ID NO: 163900 - RNA, 1701 nt, Artificial Sequence; identical to SEQ ID NO: 162378
  derived and/or modified sequence opt4 from hemagglutinin__InfluenzaA__AHL95319

SEQ ID NO: 163901 - RNA, 1701 nt, Artificial Sequence
  derived and/or modified sequence opt4 from hemagglutinin__InfluenzaA__AHL95331
augaagaccaucaucgcccugagcuacauccugugccugguguucgcccagaagcugcccggcgacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163902 - RNA, 1701 nt, Artificial Sequence
  derived and/or modified sequence opt4 from hemagglutinin__InfluenzaA__AHL95343
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucagaggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163903 - RNA, 1701 nt, Artificial Sequence; identical to SEQ ID NO: 162378
  derived and/or modified sequence opt4 from hemagglutinin__InfluenzaA__AHL95432

SEQ ID NO: 163904 - RNA, 1701 nt, Artificial Sequence; identical to SEQ ID NO: 162514
  derived and/or modified sequence opt4 from hemagglutinin__InfluenzaA__AHL95444

SEQ ID NO: 163905 - RNA, 1701 nt, Artificial Sequence; identical to SEQ ID NO: 162378
  derived and/or modified sequence opt4 from hemagglutinin__InfluenzaA__AHL95457

SEQ ID NO: 163906 - RNA, 1701 nt, Artificial Sequence
  derived and/or modified sequence opt4 from hemagglutinin__InfluenzaA__AHL95470
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugaagcagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugagacccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163907 - RNA, 1701 nt, Artificial Sequence; identical to SEQ ID NO: 162514
  derived and/or modified sequence opt4 from hemagglutinin__InfluenzaA__AHL95482

SEQ ID NO: 163908 - RNA, 1701 nt, Artificial Sequence; identical to SEQ ID NO: 162514
  derived and/or modified sequence opt4 from hemagglutinin__InfluenzaA__AHL95494

SEQ ID NO: 163909 - RNA, 1701 nt, Artificial Sequence
  derived and/or modified sequence opt4 from hemagglutinin__InfluenzaA__AHL95506
augaagaccaucaucgcccugagcuacauccugugccugguguucgcccagaagcugcccggcaacgacaacagcaccgccacccugugccugggccaccacgccgugcccaacggcaccaucgugagaaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163910 - RNA, 1701 nt, Artificial Sequence
  derived and/or modified sequence opt4 from hemagglutinin__InfluenzaA__AHL95518
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163911 - RNA, 1701 nt, Artificial Sequence; identical to SEQ ID NO: 162388
  derived and/or modified sequence opt4 from hemagglutinin__InfluenzaA__AHL95530

SEQ ID NO: 163912 - RNA, 1701 nt, Artificial Sequence; identical to SEQ ID NO: 162388
  derived and/or modified sequence opt4 from hemagglutinin__InfluenzaA__AHL95542

SEQ ID NO: 163913 - RNA, 1701 nt, Artificial Sequence
  derived and/or modified sequence opt4 from hemagglutinin__InfluenzaA__AHL95554
augaagaccaucaucgcccugagcuacauccugugccugguguucgcccagaagcugcccggcaacgacaacagcauggccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163914 - RNA, 1701 nt, Artificial Sequence
  derived and/or modified sequence opt4 from hemagglutinin__InfluenzaA__AHL95566
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163915 - RNA, 1701 nt, Artificial Sequence
  derived and/or modified sequence opt4 from hemagglutinin__InfluenzaA__AHL95578
augaagaccaucaucgcccugagcuacauccugugccugguguucgcccagaagcugcccggcaacgacgacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163916 - RNA, 1701 nt, Artificial Sequence
  derived and/or modified sequence opt4 from hemagglutinin__InfluenzaA__AHL95590
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcagcugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163917 - RNA, 1701 nt, Artificial Sequence; identical to SEQ ID NO: 162388
  derived and/or modified sequence opt4 from hemagglutinin__InfluenzaA__AHL95602

SEQ ID NO: 163918 - RNA, 1701 nt, Artificial Sequence; identical to SEQ ID NO: 162388
  derived and/or modified sequence opt4 from hemagglutinin__InfluenzaA__AHL95614

SEQ ID NO: 163919 - RNA, 1701 nt, Artificial Sequence
  derived and/or modified sequence opt4 from hemagglutinin__InfluenzaA__AHL95626
augaagaccaucaucgcccugagcuacgugcugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163920 - RNA, 1701 nt, Artificial Sequence; identical to SEQ ID NO: 162388
  derived and/or modified sequence opt4 from hemagglutinin__InfluenzaA__AHL95638

SEQ ID NO: 163921 - RNA, 1701 nt, Artificial Sequence; identical to SEQ ID NO: 162388
  derived and/or modified sequence opt4 from hemagglutinin__InfluenzaA__AHL95650

SEQ ID NO: 163922 - RNA, 1701 nt, Artificial Sequence
  derived and/or modified sequence opt4 from hemagglutinin__InfluenzaA__AHL95662
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcuggugacccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163923 - RNA, 1701 nt, Artificial Sequence; identical to SEQ ID NO: 162514
  derived and/or modified sequence opt4 from hemagglutinin__InfluenzaA__AHL95686

SEQ ID NO: 163924 - RNA, 1701 nt, Artificial Sequence; identical to SEQ ID NO: 162514
  derived and/or modified sequence opt4 from hemagglutinin__InfluenzaA__AHL95698

SEQ ID NO: 163925 - RNA, 1701 nt, Artificial Sequence; identical to SEQ ID NO: 162388
  derived and/or modified sequence opt4 from hemagglutinin__InfluenzaA__AHL95710

SEQ ID NO: 163926 - RNA, 1701 nt, Artificial Sequence; identical to SEQ ID NO: 163902
  derived and/or modified sequence opt4 from hemagglutinin__InfluenzaA__AHL95722

SEQ ID NO: 163927 - RNA, 1701 nt, Artificial Sequence; identical to SEQ ID NO: 162378
  derived and/or modified sequence opt4 from hemagglutinin__InfluenzaA__AHL95734

SEQ ID NO: 163928 - RNA, 1701 nt, Artificial Sequence; identical to SEQ ID NO: 162378
  derived and/or modified sequence opt4 from hemagglutinin__InfluenzaA__AHL95746

SEQ ID NO: 163929 - RNA, 1701 nt, Artificial Sequence; identical to SEQ ID NO: 162517
  derived and/or modified sequence opt4 from hemagglutinin__InfluenzaA__AHL95758

SEQ ID NO: 163930 - RNA, 1701 nt, Artificial Sequence; identical to SEQ ID NO: 162388
  derived and/or modified sequence opt4 from hemagglutinin__InfluenzaA__AHL95770

SEQ ID NO: 163931 - RNA, 1701 nt, Artificial Sequence
  derived and/or modified sequence opt4 from hemagglutinin__InfluenzaA__AHL95782
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163932 - RNA, 1701 nt, Artificial Sequence
  derived and/or modified sequence opt4 from hemagglutinin__InfluenzaA__AHL95794
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaaacaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163933 - RNA, 1701 nt, Artificial Sequence
  derived and/or modified sequence opt4 from hemagglutinin__InfluenzaA__AHL95806
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcagcaucaugugggccugccagaagggcaacaucagaugcaacaucugcaucuga

SEQ ID NO: 163934 - RNA, 1701 nt, Artificial Sequence; identical to SEQ ID NO: 162514
  derived and/or modified sequence opt4 from hemagglutinin__InfluenzaA__AHL95818

SEQ ID NO: 163935 - RNA, 1701 nt, Artificial Sequence; identical to SEQ ID NO: 162378
  derived and/or modified sequence opt4 from hemagglutinin__InfluenzaA__AHL95830

SEQ ID NO: 163936 - RNA, 1701 nt, Artificial Sequence; identical to SEQ ID NO: 162514
  derived and/or modified sequence opt4 from hemagglutinin__InfluenzaA__AHL95842

SEQ ID NO: 163937 - RNA, 1701 nt, Artificial Sequence; identical to SEQ ID NO: 162378
  derived and/or modified sequence opt4 from hemagglutinin__InfluenzaA__AHL95854

SEQ ID NO: 163938 - RNA, 1701 nt, Artificial Sequence; identical to SEQ ID NO: 162388
  derived and/or modified sequence opt4 from hemagglutinin__InfluenzaA__AHL95866

SEQ ID NO: 163939 - RNA, 1701 nt, Artificial Sequence
  derived and/or modified sequence opt4 from hemagglutinin__InfluenzaA__AHL95878
augaaggccauccuggugaucaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcgugagcccccugcaccugggcaagugcaacaucgccggcuggauccugggcaaccccgagugcgagagccugagcaccgccagcagcuggagcuacaucguggagaccagcggcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaucagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 163940 - RNA, 1701 nt, Artificial Sequence; identical to SEQ ID NO: 162388
  derived and/or modified sequence opt4 from hemagglutinin__InfluenzaA__AHL95889

SEQ ID NO: 163941 - RNA, 1701 nt, Artificial Sequence; identical to SEQ ID NO: 162514
  derived and/or modified sequence opt4 from hemagglutinin__InfluenzaA__AHL95901

SEQ ID NO: 163942 - RNA, 1701 nt, Artificial Sequence; identical to SEQ ID NO: 162514
  derived and/or modified sequence opt4 from hemagglutinin__InfluenzaA__AHL95913

SEQ ID NO: 163943 - RNA, 1701 nt, Artificial Sequence
  derived and/or modified sequence opt4 from hemagglutinin__InfluenzaA__AHL95937
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaccgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163944 - RNA, 1701 nt, Artificial Sequence
  derived and/or modified sequence opt4 from hemagglutinin__InfluenzaA__AHL95949
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaacuucaaguaccccgcccugaacaugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163945 - RNA, 1701 nt, Artificial Sequence; identical to SEQ ID NO: 162388
  derived and/or modified sequence opt4 from hemagglutinin__InfluenzaA__AHL95961

SEQ ID NO: 163946 - RNA, 1701 nt, Artificial Sequence; identical to SEQ ID NO: 162388
  derived and/or modified sequence opt4 from hemagglutinin__InfluenzaA__AHL95973

SEQ ID NO: 163947 - RNA, 1701 nt, Artificial Sequence; identical to SEQ ID NO: 162388
  derived and/or modified sequence opt4 from hemagglutinin__InfluenzaA__AHL95985

SEQ ID NO: 163948 - RNA, 1701 nt, Artificial Sequence
  derived and/or modified sequence opt4 from hemagglutinin__InfluenzaA__AHL95997
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcagcugcaucagaggcagcaagagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163949 - RNA, 1701 nt, Artificial Sequence
  derived and/or modified sequence opt4 from hemagglutinin__InfluenzaA__AHL96021
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaagagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163950 - RNA, 1701 nt, Artificial Sequence; identical to SEQ ID NO: 162388
  derived and/or modified sequence opt4 from hemagglutinin__InfluenzaA__AHL96033

SEQ ID NO: 163951 - RNA, 1701 nt, Artificial Sequence; identical to SEQ ID NO: 162643
  derived and/or modified sequence opt4 from hemagglutinin__InfluenzaA__AHL96045

SEQ ID NO: 163952 - RNA, 1701 nt, Artificial Sequence; identical to SEQ ID NO: 162514
  derived and/or modified sequence opt4 from hemagglutinin__InfluenzaA__AHL96056

SEQ ID NO: 163953 - RNA, 1701 nt, Artificial Sequence; identical to SEQ ID NO: 162378
  derived and/or modified sequence opt4 from hemagglutinin__InfluenzaA__AHL96068

SEQ ID NO: 163954 - RNA, 1701 nt, Artificial Sequence; identical to SEQ ID NO: 162388
  derived and/or modified sequence opt4 from hemagglutinin__InfluenzaA__AHL96080

SEQ ID NO: 163955 - RNA, 1701 nt, Artificial Sequence
  derived and/or modified sequence opt4 from hemagglutinin__InfluenzaA__AHL96092
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucaucgagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163956 - RNA, 1701 nt, Artificial Sequence
  derived and/or modified sequence opt4 from hemagglutinin__InfluenzaA__AHL96104
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163957 - RNA, 1701 nt, Artificial Sequence; identical to SEQ ID NO: 163002
  derived and/or modified sequence opt4 from hemagglutinin__InfluenzaA__AHL96116

SEQ ID NO: 163958 - RNA, 1701 nt, Artificial Sequence; identical to SEQ ID NO: 162378
  derived and/or modified sequence opt4 from hemagglutinin__InfluenzaA__AHL96128

SEQ ID NO: 163959 - RNA, 1701 nt, Artificial Sequence; identical to SEQ ID NO: 162514
  derived and/or modified sequence opt4 from hemagglutinin__InfluenzaA__AHL96152

SEQ ID NO: 163960 - RNA, 1701 nt, Artificial Sequence
  derived and/or modified sequence opt4 from hemagglutinin__InfluenzaA__AHL96164
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaagaacuggauccuguggaucagcuucgccaucagcugcuuccugcugugcguggcccugcugggcuucaucaugugggccugccagaagggcaacaucagaugcaacaucugcaucuga

SEQ ID NO: 163961 - RNA, 1701 nt, Artificial Sequence; identical to SEQ ID NO: 162514
  derived and/or modified sequence opt4 from hemagglutinin__InfluenzaA__AHL96176

SEQ ID NO: 163962 - RNA, 1701 nt, Artificial Sequence; identical to SEQ ID NO: 162514
  derived and/or modified sequence opt4 from hemagglutinin__InfluenzaA__AHL96188

SEQ ID NO: 163963 - RNA, 1701 nt, Artificial Sequence
  derived and/or modified sequence opt4 from hemagglutinin__InfluenzaA__AHL96200
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccaggugcuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163964 - RNA, 1701 nt, Artificial Sequence; identical to SEQ ID NO: 162378
  derived and/or modified sequence opt4 from hemagglutinin__InfluenzaA__AHL96212

SEQ ID NO: 163965 - RNA, 1701 nt, Artificial Sequence; identical to SEQ ID NO: 162987
  derived and/or modified sequence opt4 from hemagglutinin__InfluenzaA__AHL96224

SEQ ID NO: 163966 - RNA, 1701 nt, Artificial Sequence
  derived and/or modified sequence opt4 from hemagglutinin__InfluenzaA__AHL96236
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaugggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaagaacuggauccuguggaucagcuucgccaucagcugcuuccugcugugcguggcccugcugggcuucaucaugugggccugccagaagggcaacaucagaugcaacaucugcaucuga

SEQ ID NO: 163967 - RNA, 1701 nt, Artificial Sequence
  derived and/or modified sequence opt4 from hemagglutinin__InfluenzaA__AHL96248
augaagaccaucaucgcccugggcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucaucgagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163968 - RNA, 1701 nt, Artificial Sequence; identical to SEQ ID NO: 162514
  derived and/or modified sequence opt4 from hemagglutinin__InfluenzaA__AHL96260

SEQ ID NO: 163969 - RNA, 1701 nt, Artificial Sequence; identical to SEQ ID NO: 162378
  derived and/or modified sequence opt4 from hemagglutinin__InfluenzaA__AHL96274

SEQ ID NO: 163970 - RNA, 1701 nt, Artificial Sequence; identical to SEQ ID NO: 162514
  derived and/or modified sequence opt4 from hemagglutinin__InfluenzaA__AHL96304

SEQ ID NO: 163971 - RNA, 1701 nt, Artificial Sequence; identical to SEQ ID NO: 162355
  derived and/or modified sequence opt4 from hemagglutinin__InfluenzaA__AHL96318

SEQ ID NO: 163972 - RNA, 1701 nt, Artificial Sequence; identical to SEQ ID NO: 162514
  derived and/or modified sequence opt4 from hemagglutinin__InfluenzaA__AHL96330

SEQ ID NO: 163973 - RNA, 1701 nt, Artificial Sequence; identical to SEQ ID NO: 162517
  derived and/or modified sequence opt4 from hemagglutinin__InfluenzaA__AHL96342

SEQ ID NO: 163974 - RNA, 1701 nt, Artificial Sequence
  derived and/or modified sequence opt4 from hemagglutinin__InfluenzaA__AHL96354
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccugaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163975 - RNA, 1701 nt, Artificial Sequence
  derived and/or modified sequence opt4 from hemagglutinin__InfluenzaA__AHL96366
augaagaccaucaucgcccugagcuacauccugugccugguguucgcccagaagcugcccgagaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163976 - RNA, 1701 nt, Artificial Sequence; identical to SEQ ID NO: 162388
  derived and/or modified sequence opt4 from hemagglutinin__InfluenzaA__AHL96378

SEQ ID NO: 163977 - RNA, 1701 nt, Artificial Sequence; identical to SEQ ID NO: 162378
  derived and/or modified sequence opt4 from hemagglutinin__InfluenzaA__AHL96390

SEQ ID NO: 163978 - RNA, 1701 nt, Artificial Sequence
  derived and/or modified sequence opt4 from hemagglutinin__InfluenzaA__AHL96402
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacaagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163979 - RNA, 1701 nt, Artificial Sequence; identical to SEQ ID NO: 162388
  derived and/or modified sequence opt4 from hemagglutinin__InfluenzaA__AHL96414

SEQ ID NO: 163980 - RNA, 1701 nt, Artificial Sequence; identical to SEQ ID NO: 162514
  derived and/or modified sequence opt4 from hemagglutinin__InfluenzaA__AHL96426

SEQ ID NO: 163981 - RNA, 1701 nt, Artificial Sequence
  derived and/or modified sequence opt4 from hemagglutinin__InfluenzaA__AHL96438
augaagaccaucaucgcccugagcuacauccugugccugguguucgcccaggagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcagcagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163982 - RNA, 1701 nt, Artificial Sequence; identical to SEQ ID NO: 162388
  derived and/or modified sequence opt4 from hemagglutinin__InfluenzaA__AHL96450

SEQ ID NO: 163983 - RNA, 1701 nt, Artificial Sequence; identical to SEQ ID NO: 162514
  derived and/or modified sequence opt4 from hemagglutinin__InfluenzaA__AHL96462

SEQ ID NO: 163984 - RNA, 1701 nt, Artificial Sequence
  derived and/or modified sequence opt4 from hemagglutinin__InfluenzaA__AHL96474
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcgugagcccccugcaccugggcaagugcaacaucgccggcuggauccugggcaaccccgagugcgagagccugagcaccgccagcagcuggagcuacaucguggagaccagcggcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaucagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 163985 - RNA, 1701 nt, Artificial Sequence
  derived and/or modified sequence opt4 from hemagglutinin__InfluenzaA__AHL96485
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugaagagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163986 - RNA, 1701 nt, Artificial Sequence; identical to SEQ ID NO: 162514
  derived and/or modified sequence opt4 from hemagglutinin__InfluenzaA__AHL96497

SEQ ID NO: 163987 - RNA, 1701 nt, Artificial Sequence; identical to SEQ ID NO: 162388
  derived and/or modified sequence opt4 from hemagglutinin__InfluenzaA__AHL96509

SEQ ID NO: 163988 - RNA, 1701 nt, Artificial Sequence; identical to SEQ ID NO: 162355
  derived and/or modified sequence opt4 from hemagglutinin__InfluenzaA__AHL96521

SEQ ID NO: 163989 - RNA, 1701 nt, Artificial Sequence; identical to SEQ ID NO: 162514
  derived and/or modified sequence opt4 from hemagglutinin__InfluenzaA__AHL96533

SEQ ID NO: 163990 - RNA, 1701 nt, Artificial Sequence; identical to SEQ ID NO: 162378
  derived and/or modified sequence opt4 from hemagglutinin__InfluenzaA__AHL96545

SEQ ID NO: 163991 - RNA, 1701 nt, Artificial Sequence
  derived and/or modified sequence opt4 from hemagglutinin__InfluenzaA__AHL96569
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagagugaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163992 - RNA, 1701 nt, Artificial Sequence; identical to SEQ ID NO: 163984
  derived and/or modified sequence opt4 from hemagglutinin__InfluenzaA__AHL96581

SEQ ID NO: 163993 - RNA, 1701 nt, Artificial Sequence
  derived and/or modified sequence opt4 from hemagglutinin__InfluenzaA__AHL96592
augaagaccaucaucgcccugggcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucaucgagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163994 - RNA, 1701 nt, Artificial Sequence; identical to SEQ ID NO: 162514
  derived and/or modified sequence opt4 from hemagglutinin__InfluenzaA__AHL96604

SEQ ID NO: 163995 - RNA, 1701 nt, Artificial Sequence; identical to SEQ ID NO: 162514
  derived and/or modified sequence opt4 from hemagglutinin__InfluenzaA__AHL96616

SEQ ID NO: 163996 - RNA, 1701 nt, Artificial Sequence
  derived and/or modified sequence opt4 from hemagglutinin__InfluenzaA__AHL96628
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcuggggcggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163997 - RNA, 1701 nt, Artificial Sequence; identical to SEQ ID NO: 163985
  derived and/or modified sequence opt4 from hemagglutinin__InfluenzaA__AHL96640

SEQ ID NO: 163998 - RNA, 1701 nt, Artificial Sequence
  derived and/or modified sequence opt4 from hemagglutinin__InfluenzaA__AHL96652
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcaggacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 163999 - RNA, 1701 nt, Artificial Sequence; identical to SEQ ID NO: 162987
  derived and/or modified sequence opt4 from hemagglutinin__InfluenzaA__AHL96664

SEQ ID NO: 164000 - RNA, 1701 nt, Artificial Sequence
  derived and/or modified sequence opt4 from hemagglutinin__InfluenzaA__AHL96676
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaucgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164001 - RNA, 1701 nt, Artificial Sequence; identical to SEQ ID NO: 162514
  derived and/or modified sequence opt4 from hemagglutinin__InfluenzaA__AHL96688

SEQ ID NO: 164002 - RNA, 1701 nt, Artificial Sequence; identical to SEQ ID NO: 162514
  derived and/or modified sequence opt4 from hemagglutinin__InfluenzaA__AHL96700

SEQ ID NO: 164003 - RNA, 1701 nt, Artificial Sequence; identical to SEQ ID NO: 162514
  derived and/or modified sequence opt4 from hemagglutinin__InfluenzaA__AHL96712

SEQ ID NO: 164004 - RNA, 1701 nt, Artificial Sequence; identical to SEQ ID NO: 162388
  derived and/or modified sequence opt4 from hemagglutinin__InfluenzaA__AHL96724

SEQ ID NO: 164005 - RNA, 1701 nt, Artificial Sequence; identical to SEQ ID NO: 162378
  derived and/or modified sequence opt4 from hemagglutinin__InfluenzaA__AHL96748

SEQ ID NO: 164006 - RNA, 1701 nt, Artificial Sequence; identical to SEQ ID NO: 162388
  derived and/or modified sequence opt4 from hemagglutinin__InfluenzaA__AHL96784

SEQ ID NO: 164007 - RNA, 1701 nt, Artificial Sequence
  derived and/or modified sequence opt4 from hemagglutinin__InfluenzaA__AHL96796
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucaucgagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164008 - RNA, 1701 nt, Artificial Sequence; identical to SEQ ID NO: 162378
  derived and/or modified sequence opt4 from hemagglutinin__InfluenzaA__AHL96808

SEQ ID NO: 164009 - RNA, 1701 nt, Artificial Sequence; identical to SEQ ID NO: 162378
  derived and/or modified sequence opt4 from hemagglutinin__InfluenzaA__AHL96820

SEQ ID NO: 164010 - RNA, 1701 nt, Artificial Sequence; identical to SEQ ID NO: 162388
  derived and/or modified sequence opt4 from hemagglutinin__InfluenzaA__AHL96832

SEQ ID NO: 164011 - RNA, 1701 nt, Artificial Sequence; identical to SEQ ID NO: 162388
  derived and/or modified sequence opt4 from hemagglutinin__InfluenzaA__AHL96844

SEQ ID NO: 164012 - RNA, 1701 nt, Artificial Sequence; identical to SEQ ID NO: 162388
  derived and/or modified sequence opt4 from hemagglutinin__InfluenzaA__AHL96856

SEQ ID NO: 164013 - RNA, 1701 nt, Artificial Sequence
  derived and/or modified sequence opt4 from hemagglutinin__InfluenzaA__AHL96868
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcggcaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccguggugcccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaugagcugcuuccugcugugcguggcccugcugggcuucaucaugugggccugccagaagggcaacaucagaugcaacaucugcaucuga

SEQ ID NO: 164014 - RNA, 1701 nt, Artificial Sequence; identical to SEQ ID NO: 162378
  derived and/or modified sequence opt4 from hemagglutinin__InfluenzaA__AHL96880

SEQ ID NO: 164015 - RNA, 1701 nt, Artificial Sequence
  derived and/or modified sequence opt4 from hemagglutinin__InfluenzaA__AHL96892
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagagugcaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164016 - RNA, 1701 nt, Artificial Sequence
  derived and/or modified sequence opt4 from hemagglutinin__InfluenzaA__AHL96904
augaagaccaucaucgcccugagcuacauccugugccugguguucgcccagaagcugcccggcaacgacaacagcaccgccacccugugccugggccaccacgccgugcccaacggcaugaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccguggugcccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaugagcugcuuccugcugugcguggcccugcugggcagcaucaugugggccugccagaagggcaacaucagaugcaacaucugcaucuga

SEQ ID NO: 164017 - RNA, 1701 nt, Artificial Sequence; identical to SEQ ID NO: 162378
  derived and/or modified sequence opt4 from hemagglutinin__InfluenzaA__AHL96916

SEQ ID NO: 164018 - RNA, 1701 nt, Artificial Sequence; identical to SEQ ID NO: 162378
  derived and/or modified sequence opt4 from hemagglutinin__InfluenzaA__AHL96928

SEQ ID NO: 164019 - RNA, 1701 nt, Artificial Sequence; identical to SEQ ID NO: 162378
  derived and/or modified sequence opt4 from hemagglutinin__InfluenzaA__AHL96940

SEQ ID NO: 164020 - RNA, 1701 nt, Artificial Sequence; identical to SEQ ID NO: 162388
  derived and/or modified sequence opt4 from hemagglutinin__InfluenzaA__AHL96952

SEQ ID NO: 164021 - RNA, 1701 nt, Artificial Sequence; identical to SEQ ID NO: 162388
  derived and/or modified sequence opt4 from hemagglutinin__InfluenzaA__AHL96964

SEQ ID NO: 164022 - RNA, 1701 nt, Artificial Sequence; identical to SEQ ID NO: 162546
  derived and/or modified sequence opt4 from hemagglutinin__InfluenzaA__AHL96976

SEQ ID NO: 164023 - RNA, 1701 nt, Artificial Sequence
  derived and/or modified sequence opt4 from hemagglutinin__InfluenzaA__AHL96988
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugagacccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164024 - RNA, 1701 nt, Artificial Sequence; identical to SEQ ID NO: 162388
  derived and/or modified sequence opt4 from hemagglutinin__InfluenzaA__AHL97000

SEQ ID NO: 164025 - RNA, 1701 nt, Artificial Sequence; identical to SEQ ID NO: 162514
  derived and/or modified sequence opt4 from hemagglutinin__InfluenzaA__AHL97012

SEQ ID NO: 164026 - RNA, 1701 nt, Artificial Sequence
  derived and/or modified sequence opt4 from hemagglutinin__InfluenzaA__AHL97024
augaagaccaucaucgcccugagcuacauccugugccugguguucgcccagaagcugcccggcaacgacaacagcaccgccacccugugccugggccaccacgccgugcccaacggcaccaucgugaagaccaucaugaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164027 - RNA, 1701 nt, Artificial Sequence
  derived and/or modified sequence opt4 from hemagglutinin__InfluenzaA__AHL97036
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacaccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164028 - RNA, 1701 nt, Artificial Sequence; identical to SEQ ID NO: 162403
  derived and/or modified sequence opt4 from hemagglutinin__InfluenzaA__AHL97048

SEQ ID NO: 164029 - RNA, 1701 nt, Artificial Sequence
  derived and/or modified sequence opt4 from hemagglutinin__InfluenzaA__AHL97060
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgagcacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164030 - RNA, 1701 nt, Artificial Sequence; identical to SEQ ID NO: 162514
  derived and/or modified sequence opt4 from hemagglutinin__InfluenzaA__AHL97072

SEQ ID NO: 164031 - RNA, 1701 nt, Artificial Sequence; identical to SEQ ID NO: 162514
  derived and/or modified sequence opt4 from hemagglutinin__InfluenzaA__AHL97084

SEQ ID NO: 164032 - RNA, 1701 nt, Artificial Sequence; identical to SEQ ID NO: 162355
  derived and/or modified sequence opt4 from hemagglutinin__InfluenzaA__AHL97096

SEQ ID NO: 164033 - RNA, 1701 nt, Artificial Sequence; identical to SEQ ID NO: 162517
  derived and/or modified sequence opt4 from hemagglutinin__InfluenzaA__AHL97108

SEQ ID NO: 164034 - RNA, 1701 nt, Artificial Sequence
  derived and/or modified sequence opt4 from hemagglutinin__InfluenzaA__AHL97120
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagagugaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucaucaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164035 - RNA, 1701 nt, Artificial Sequence
  derived and/or modified sequence opt4 from hemagglutinin__InfluenzaA__AHL97132
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccggcaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164036 - RNA, 1701 nt, Artificial Sequence; identical to SEQ ID NO: 162514
  derived and/or modified sequence opt4 from hemagglutinin__InfluenzaA__AHL97144

SEQ ID NO: 164037 - RNA, 1701 nt, Artificial Sequence; identical to SEQ ID NO: 162514
  derived and/or modified sequence opt4 from hemagglutinin__InfluenzaA__AHL97156

SEQ ID NO: 164038 - RNA, 1701 nt, Artificial Sequence; identical to SEQ ID NO: 162514
  derived and/or modified sequence opt4 from hemagglutinin__InfluenzaA__AHL97168

SEQ ID NO: 164039 - RNA, 1701 nt, Artificial Sequence; identical to SEQ ID NO: 162388
  derived and/or modified sequence opt4 from hemagglutinin__InfluenzaA__AHL97180

SEQ ID NO: 164040 - RNA, 1701 nt, Artificial Sequence; identical to SEQ ID NO: 162514
  derived and/or modified sequence opt4 from hemagglutinin__InfluenzaA__AHL97192

SEQ ID NO: 164041 - RNA, 1701 nt, Artificial Sequence; identical to SEQ ID NO: 162514
  derived and/or modified sequence opt4 from hemagglutinin__InfluenzaA__AHL97204

SEQ ID NO: 164042 - RNA, 1701 nt, Artificial Sequence; identical to SEQ ID NO: 162514
  derived and/or modified sequence opt4 from hemagglutinin__InfluenzaA__AHL97216

SEQ ID NO: 164043 - RNA, 1701 nt, Artificial Sequence
  derived and/or modified sequence opt4 from hemagglutinin__InfluenzaA__AHL97228
augaagaccaucaucgcccugagcuacauccugugccugguguucgcccagaagcugcccggcaacgacaacagcaccgccacccugugccugggccaccacgccgugcccaacggcaccguggugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 164044 - RNA, 1701 nt, Artificial Sequence; identical to SEQ ID NO: 162514
  derived and/or modified sequence opt4 from hemagglutinin__InfluenzaA__AHL97240

SEQ ID NO: 164045 - RNA, 1701 nt, Artificial Sequence
  derived and/or modified sequence opt4 from hemagglutinin__InfluenzaA__AHL97252
augaagaccaucaucgcccugagcuacauccugugccugguguucgcccaggagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagaacuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164046 - RNA, 1701 nt, Artificial Sequence; identical to SEQ ID NO: 162378
  derived and/or modified sequence opt4 from hemagglutinin__InfluenzaA__AHL97264

SEQ ID NO: 164047 - RNA, 1701 nt, Artificial Sequence; identical to SEQ ID NO: 162514
  derived and/or modified sequence opt4 from hemagglutinin__InfluenzaA__AHL97276

SEQ ID NO: 164048 - RNA, 1701 nt, Artificial Sequence
  derived and/or modified sequence opt4 from hemagglutinin__InfluenzaA__AHL97288
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaucaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164049 - RNA, 1701 nt, Artificial Sequence; identical to SEQ ID NO: 162388
  derived and/or modified sequence opt4 from hemagglutinin__InfluenzaA__AHL97300

SEQ ID NO: 164050 - RNA, 1701 nt, Artificial Sequence; identical to SEQ ID NO: 162514
  derived and/or modified sequence opt4 from hemagglutinin__InfluenzaA__AHL97312

SEQ ID NO: 164051 - RNA, 1701 nt, Artificial Sequence; identical to SEQ ID NO: 162514
  derived and/or modified sequence opt4 from hemagglutinin__InfluenzaA__AHL97336

SEQ ID NO: 164052 - RNA, 1701 nt, Artificial Sequence; identical to SEQ ID NO: 162514
  derived and/or modified sequence opt4 from hemagglutinin__InfluenzaA__AHL97348

SEQ ID NO: 164053 - RNA, 1701 nt, Artificial Sequence
  derived and/or modified sequence opt4 from hemagglutinin__InfluenzaA__AHL97372
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaacgccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164054 - RNA, 1701 nt, Artificial Sequence; identical to SEQ ID NO: 162514
  derived and/or modified sequence opt4 from hemagglutinin__InfluenzaA__AHL97384

SEQ ID NO: 164055 - RNA, 1701 nt, Artificial Sequence; identical to SEQ ID NO: 162378
  derived and/or modified sequence opt4 from hemagglutinin__InfluenzaA__AHL97396

SEQ ID NO: 164056 - RNA, 1701 nt, Artificial Sequence; identical to SEQ ID NO: 162355
  derived and/or modified sequence opt4 from hemagglutinin__InfluenzaA__AHL97408

SEQ ID NO: 164057 - RNA, 1701 nt, Artificial Sequence; identical to SEQ ID NO: 164026
  derived and/or modified sequence opt4 from hemagglutinin__InfluenzaA__AHL97420

SEQ ID NO: 164058 - RNA, 1701 nt, Artificial Sequence
  derived and/or modified sequence opt4 from hemagglutinin__InfluenzaA__AHL97444
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcaccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164059 - RNA, 1701 nt, Artificial Sequence; identical to SEQ ID NO: 162388
  derived and/or modified sequence opt4 from hemagglutinin__InfluenzaA__AHL97456

SEQ ID NO: 164060 - RNA, 1701 nt, Artificial Sequence
  derived and/or modified sequence opt4 from hemagglutinin__InfluenzaA__AHL97468
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164061 - RNA, 1701 nt, Artificial Sequence; identical to SEQ ID NO: 162514
  derived and/or modified sequence opt4 from hemagglutinin__InfluenzaA__AHL97480

SEQ ID NO: 164062 - RNA, 1701 nt, Artificial Sequence; identical to SEQ ID NO: 162514
  derived and/or modified sequence opt4 from hemagglutinin__InfluenzaA__AHL97493

SEQ ID NO: 164063 - RNA, 1701 nt, Artificial Sequence; identical to SEQ ID NO: 164026
  derived and/or modified sequence opt4 from hemagglutinin__InfluenzaA__AHL97505

SEQ ID NO: 164064 - RNA, 1701 nt, Artificial Sequence
  derived and/or modified sequence opt4 from hemagglutinin__InfluenzaA__AHL97517
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcacccagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164065 - RNA, 1701 nt, Artificial Sequence; identical to SEQ ID NO: 162403
  derived and/or modified sequence opt4 from hemagglutinin__InfluenzaA__AHL97529

SEQ ID NO: 164066 - RNA, 1701 nt, Artificial Sequence; identical to SEQ ID NO: 162388
  derived and/or modified sequence opt4 from hemagglutinin__InfluenzaA__AHL97541

SEQ ID NO: 164067 - RNA, 1701 nt, Artificial Sequence; identical to SEQ ID NO: 162514
  derived and/or modified sequence opt4 from hemagglutinin__InfluenzaA__AHL97553

SEQ ID NO: 164068 - RNA, 1701 nt, Artificial Sequence; identical to SEQ ID NO: 162355
  derived and/or modified sequence opt4 from hemagglutinin__InfluenzaA__AHL97565

SEQ ID NO: 164069 - RNA, 1701 nt, Artificial Sequence
  derived and/or modified sequence opt4 from hemagglutinin__InfluenzaA__AHL97577
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagcccggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164070 - RNA, 1701 nt, Artificial Sequence; identical to SEQ ID NO: 162543
  derived and/or modified sequence opt4 from hemagglutinin__InfluenzaA__AHL97589

SEQ ID NO: 164071 - RNA, 1701 nt, Artificial Sequence; identical to SEQ ID NO: 162514
  derived and/or modified sequence opt4 from hemagglutinin__InfluenzaA__AHL97601

SEQ ID NO: 164072 - RNA, 1701 nt, Artificial Sequence; identical to SEQ ID NO: 162378
  derived and/or modified sequence opt4 from hemagglutinin__InfluenzaA__AHL97613

SEQ ID NO: 164073 - RNA, 1701 nt, Artificial Sequence; identical to SEQ ID NO: 164060
  derived and/or modified sequence opt4 from hemagglutinin__InfluenzaA__AHL97625

SEQ ID NO: 164074 - RNA, 1701 nt, Artificial Sequence; identical to SEQ ID NO: 162388
  derived and/or modified sequence opt4 from hemagglutinin__InfluenzaA__AHL97637

SEQ ID NO: 164075 - RNA, 1701 nt, Artificial Sequence
  derived and/or modified sequence opt4 from hemagglutinin__InfluenzaA__AHL97661
augaagaccaucaucgcccugggcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164076 - RNA, 1701 nt, Artificial Sequence
  derived and/or modified sequence opt4 from hemagglutinin__InfluenzaA__AHL97673
augaagaccaccaucgcccugagcuacauccugugccugguguucgcccaggagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164077 - RNA, 1701 nt, Artificial Sequence; identical to SEQ ID NO: 162514
  derived and/or modified sequence opt4 from hemagglutinin__InfluenzaA__AHL97685

SEQ ID NO: 164078 - RNA, 1701 nt, Artificial Sequence
  derived and/or modified sequence opt4 from hemagglutinin__InfluenzaA__AHL97697
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaggcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164079 - RNA, 1701 nt, Artificial Sequence; identical to SEQ ID NO: 162388
  derived and/or modified sequence opt4 from hemagglutinin__InfluenzaA__AHL97709

SEQ ID NO: 164080 - RNA, 1701 nt, Artificial Sequence; identical to SEQ ID NO: 162514
  derived and/or modified sequence opt4 from hemagglutinin__InfluenzaA__AHL97721

SEQ ID NO: 164081 - RNA, 1701 nt, Artificial Sequence; identical to SEQ ID NO: 162388
  derived and/or modified sequence opt4 from hemagglutinin__InfluenzaA__AHL97733

SEQ ID NO: 164082 - RNA, 1701 nt, Artificial Sequence; identical to SEQ ID NO: 162378
  derived and/or modified sequence opt4 from hemagglutinin__InfluenzaA__AHL97745

SEQ ID NO: 164083 - RNA, 1701 nt, Artificial Sequence; identical to SEQ ID NO: 162514
  derived and/or modified sequence opt4 from hemagglutinin__InfluenzaA__AHL97757

SEQ ID NO: 164084 - RNA, 1701 nt, Artificial Sequence; identical to SEQ ID NO: 162514
  derived and/or modified sequence opt4 from hemagglutinin__InfluenzaA__AHL97769

SEQ ID NO: 164085 - RNA, 1701 nt, Artificial Sequence
  derived and/or modified sequence opt4 from hemagglutinin__InfluenzaA__AHL97781
augaagaccaucaucgcccugagcuacauccugugccugguguucgcccaggagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaacagcagcaucaugagaagcgacgcccccaucggcaagugcaacagcaccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164086 - RNA, 1701 nt, Artificial Sequence; identical to SEQ ID NO: 162514
  derived and/or modified sequence opt4 from hemagglutinin__InfluenzaA__AHL97793

SEQ ID NO: 164087 - RNA, 1701 nt, Artificial Sequence
  derived and/or modified sequence opt4 from hemagglutinin__InfluenzaA__AHL97805
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacuacgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164088 - RNA, 1701 nt, Artificial Sequence; identical to SEQ ID NO: 162388
  derived and/or modified sequence opt4 from hemagglutinin__InfluenzaA__AHL97817

SEQ ID NO: 164089 - RNA, 1701 nt, Artificial Sequence; identical to SEQ ID NO: 164078
  derived and/or modified sequence opt4 from hemagglutinin__InfluenzaA__AHL97829

SEQ ID NO: 164090 - RNA, 1701 nt, Artificial Sequence; identical to SEQ ID NO: 162514
  derived and/or modified sequence opt4 from hemagglutinin__InfluenzaA__AHL97841

SEQ ID NO: 164091 - RNA, 1701 nt, Artificial Sequence; identical to SEQ ID NO: 162514
  derived and/or modified sequence opt4 from hemagglutinin__InfluenzaA__AHL97853

SEQ ID NO: 164092 - RNA, 1701 nt, Artificial Sequence; identical to SEQ ID NO: 162514
  derived and/or modified sequence opt4 from hemagglutinin__InfluenzaA__AHL97865

SEQ ID NO: 164093 - RNA, 1701 nt, Artificial Sequence; identical to SEQ ID NO: 162514
  derived and/or modified sequence opt4 from hemagglutinin__InfluenzaA__AHL97877

SEQ ID NO: 164094 - RNA, 1701 nt, Artificial Sequence; identical to SEQ ID NO: 162388
  derived and/or modified sequence opt4 from hemagglutinin__InfluenzaA__AHL97889

SEQ ID NO: 164095 - RNA, 1701 nt, Artificial Sequence; identical to SEQ ID NO: 162388
  derived and/or modified sequence opt4 from hemagglutinin__InfluenzaA__AHL97901

SEQ ID NO: 164096 - RNA, 1701 nt, Artificial Sequence; identical to SEQ ID NO: 162378
  derived and/or modified sequence opt4 from hemagglutinin__InfluenzaA__AHL97913

SEQ ID NO: 164097 - RNA, 1701 nt, Artificial Sequence
  derived and/or modified sequence opt4 from hemagglutinin__InfluenzaA__AHL97925
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcugcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164098 - RNA, 1701 nt, Artificial Sequence; identical to SEQ ID NO: 162378
  derived and/or modified sequence opt4 from hemagglutinin__InfluenzaA__AHL97937

SEQ ID NO: 164099 - RNA, 1701 nt, Artificial Sequence; identical to SEQ ID NO: 164058
  derived and/or modified sequence opt4 from hemagglutinin__InfluenzaA__AHL97949

SEQ ID NO: 164100 - RNA, 1701 nt, Artificial Sequence; identical to SEQ ID NO: 162388
  derived and/or modified sequence opt4 from hemagglutinin__InfluenzaA__AHL97961

SEQ ID NO: 164101 - RNA, 1701 nt, Artificial Sequence; identical to SEQ ID NO: 162388
  derived and/or modified sequence opt4 from hemagglutinin__InfluenzaA__AHL97973

SEQ ID NO: 164102 - RNA, 1701 nt, Artificial Sequence; identical to SEQ ID NO: 162388
  derived and/or modified sequence opt4 from hemagglutinin__InfluenzaA__AHL97985

SEQ ID NO: 164103 - RNA, 1701 nt, Artificial Sequence
  derived and/or modified sequence opt4 from hemagglutinin__InfluenzaA__AHL97997
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucagaggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164104 - RNA, 1701 nt, Artificial Sequence; identical to SEQ ID NO: 162514
  derived and/or modified sequence opt4 from hemagglutinin__InfluenzaA__AHL98009

SEQ ID NO: 164105 - RNA, 1701 nt, Artificial Sequence
  derived and/or modified sequence opt4 from hemagglutinin__InfluenzaA__AHL98021
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcaagaucugcgacagcccccaccagauccuggacggcgagaacugcacccugauggacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164106 - RNA, 1701 nt, Artificial Sequence; identical to SEQ ID NO: 162388
  derived and/or modified sequence opt4 from hemagglutinin__InfluenzaA__AHL98033

SEQ ID NO: 164107 - RNA, 1701 nt, Artificial Sequence; identical to SEQ ID NO: 163985
  derived and/or modified sequence opt4 from hemagglutinin__InfluenzaA__AHL98045

SEQ ID NO: 164108 - RNA, 1701 nt, Artificial Sequence; identical to SEQ ID NO: 163985
  derived and/or modified sequence opt4 from hemagglutinin__InfluenzaA__AHL98057

SEQ ID NO: 164109 - RNA, 1701 nt, Artificial Sequence; identical to SEQ ID NO: 163985
  derived and/or modified sequence opt4 from hemagglutinin__InfluenzaA__AHL98069

SEQ ID NO: 164110 - RNA, 1701 nt, Artificial Sequence
  derived and/or modified sequence opt4 from hemagglutinin__InfluenzaA__AHL98081
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcacccagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacuggugggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164111 - RNA, 1701 nt, Artificial Sequence; identical to SEQ ID NO: 162378
  derived and/or modified sequence opt4 from hemagglutinin__InfluenzaA__AHL98093

SEQ ID NO: 164112 - RNA, 1701 nt, Artificial Sequence
  derived and/or modified sequence opt4 from hemagglutinin__InfluenzaA__AHL98105
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcggcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaucagcuacaucaacgacaagggcaaggaggugcuggugcuguggggcauccaccaccccagcaccaccgccgaccagcagagccuguaccagaacgccgacaccuacguguucgugggcgccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 164113 - RNA, 1701 nt, Artificial Sequence; identical to SEQ ID NO: 162378
  derived and/or modified sequence opt4 from hemagglutinin__InfluenzaA__AHL98116

SEQ ID NO: 164114 - RNA, 1701 nt, Artificial Sequence; identical to SEQ ID NO: 162388
  derived and/or modified sequence opt4 from hemagglutinin__InfluenzaA__AHL98128

SEQ ID NO: 164115 - RNA, 1701 nt, Artificial Sequence; identical to SEQ ID NO: 162378
  derived and/or modified sequence opt4 from hemagglutinin__InfluenzaA__AHL98140

SEQ ID NO: 164116 - RNA, 1701 nt, Artificial Sequence; identical to SEQ ID NO: 162378
  derived and/or modified sequence opt4 from hemagglutinin__InfluenzaA__AHL98152

SEQ ID NO: 164117 - RNA, 1701 nt, Artificial Sequence; identical to SEQ ID NO: 162388
  derived and/or modified sequence opt4 from hemagglutinin__InfluenzaA__AHL98164

SEQ ID NO: 164118 - RNA, 1701 nt, Artificial Sequence; identical to SEQ ID NO: 162388
  derived and/or modified sequence opt4 from hemagglutinin__InfluenzaA__AHL98176

SEQ ID NO: 164119 - RNA, 1701 nt, Artificial Sequence; identical to SEQ ID NO: 162378
  derived and/or modified sequence opt4 from hemagglutinin__InfluenzaA__AHL98188

SEQ ID NO: 164120 - RNA, 1701 nt, Artificial Sequence; identical to SEQ ID NO: 162543
  derived and/or modified sequence opt4 from hemagglutinin__InfluenzaA__AHL98200

SEQ ID NO: 164121 - RNA, 1701 nt, Artificial Sequence; identical to SEQ ID NO: 162378
  derived and/or modified sequence opt4 from hemagglutinin__InfluenzaA__AHL98212

SEQ ID NO: 164122 - RNA, 1701 nt, Artificial Sequence; identical to SEQ ID NO: 162378
  derived and/or modified sequence opt4 from hemagglutinin__InfluenzaA__AHL98224

SEQ ID NO: 164123 - RNA, 1701 nt, Artificial Sequence; identical to SEQ ID NO: 162514
  derived and/or modified sequence opt4 from hemagglutinin__InfluenzaA__AHL98236

SEQ ID NO: 164124 - RNA, 1701 nt, Artificial Sequence; identical to SEQ ID NO: 162388
  derived and/or modified sequence opt4 from hemagglutinin__InfluenzaA__AHL98248

SEQ ID NO: 164125 - RNA, 1701 nt, Artificial Sequence; identical to SEQ ID NO: 162378
  derived and/or modified sequence opt4 from hemagglutinin__InfluenzaA__AHL98260

SEQ ID NO: 164126 - RNA, 1701 nt, Artificial Sequence; identical to SEQ ID NO: 162388
  derived and/or modified sequence opt4 from hemagglutinin__InfluenzaA__AHL98272

SEQ ID NO: 164127 - RNA, 1701 nt, Artificial Sequence; identical to SEQ ID NO: 163984
  derived and/or modified sequence opt4 from hemagglutinin__InfluenzaA__AHL98284

SEQ ID NO: 164128 - RNA, 1701 nt, Artificial Sequence
  derived and/or modified sequence opt4 from hemagglutinin__InfluenzaA__AHL98295
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164129 - RNA, 1701 nt, Artificial Sequence; identical to SEQ ID NO: 164026
  derived and/or modified sequence opt4 from hemagglutinin__InfluenzaA__AHL98307

SEQ ID NO: 164130 - RNA, 1701 nt, Artificial Sequence; identical to SEQ ID NO: 162388
  derived and/or modified sequence opt4 from hemagglutinin__InfluenzaA__AHL98319

SEQ ID NO: 164131 - RNA, 1701 nt, Artificial Sequence; identical to SEQ ID NO: 162388
  derived and/or modified sequence opt4 from hemagglutinin__InfluenzaA__AHL98331

SEQ ID NO: 164132 - RNA, 1701 nt, Artificial Sequence; identical to SEQ ID NO: 162514
  derived and/or modified sequence opt4 from hemagglutinin__InfluenzaA__AHL98343

SEQ ID NO: 164133 - RNA, 1701 nt, Artificial Sequence; identical to SEQ ID NO: 164026
  derived and/or modified sequence opt4 from hemagglutinin__InfluenzaA__AHL98354

SEQ ID NO: 164134 - RNA, 1701 nt, Artificial Sequence; identical to SEQ ID NO: 162378
  derived and/or modified sequence opt4 from hemagglutinin__InfluenzaA__AHL98366

SEQ ID NO: 164135 - RNA, 1701 nt, Artificial Sequence; identical to SEQ ID NO: 162378
  derived and/or modified sequence opt4 from hemagglutinin__InfluenzaA__AHL98378

SEQ ID NO: 164136 - RNA, 1701 nt, Artificial Sequence; identical to SEQ ID NO: 162378
  derived and/or modified sequence opt4 from hemagglutinin__InfluenzaA__AHL98390

SEQ ID NO: 164137 - RNA, 1701 nt, Artificial Sequence; identical to SEQ ID NO: 162378
  derived and/or modified sequence opt4 from hemagglutinin__InfluenzaA__AHL98402

SEQ ID NO: 164138 - RNA, 1701 nt, Artificial Sequence; identical to SEQ ID NO: 162388
  derived and/or modified sequence opt4 from hemagglutinin__InfluenzaA__AHL98414

SEQ ID NO: 164139 - RNA, 1701 nt, Artificial Sequence
  derived and/or modified sequence opt4 from hemagglutinin__InfluenzaA__AHL98426
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccaggugaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164140 - RNA, 1701 nt, Artificial Sequence; identical to SEQ ID NO: 162560
  derived and/or modified sequence opt4 from hemagglutinin__InfluenzaA__AHL98438

SEQ ID NO: 164141 - RNA, 1701 nt, Artificial Sequence; identical to SEQ ID NO: 162560
  derived and/or modified sequence opt4 from hemagglutinin__InfluenzaA__AHL98449

SEQ ID NO: 164142 - RNA, 1701 nt, Artificial Sequence
  derived and/or modified sequence opt4 from hemagglutinin__InfluenzaA__AHL98471
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagaaguucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagagagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164143 - RNA, 1701 nt, Artificial Sequence; identical to SEQ ID NO: 162514
  derived and/or modified sequence opt4 from hemagglutinin__InfluenzaA__AHL98482

SEQ ID NO: 164144 - RNA, 1701 nt, Artificial Sequence; identical to SEQ ID NO: 162355
  derived and/or modified sequence opt4 from hemagglutinin__InfluenzaA__AHL98494

SEQ ID NO: 164145 - RNA, 1701 nt, Artificial Sequence; identical to SEQ ID NO: 162514
  derived and/or modified sequence opt4 from hemagglutinin__InfluenzaA__AHL98506

SEQ ID NO: 164146 - RNA, 1701 nt, Artificial Sequence; identical to SEQ ID NO: 162514
  derived and/or modified sequence opt4 from hemagglutinin__InfluenzaA__AHL98518

SEQ ID NO: 164147 - RNA, 1701 nt, Artificial Sequence; identical to SEQ ID NO: 162355
  derived and/or modified sequence opt4 from hemagglutinin__InfluenzaA__AHL98530

SEQ ID NO: 164148 - RNA, 1701 nt, Artificial Sequence; identical to SEQ ID NO: 162514
  derived and/or modified sequence opt4 from hemagglutinin__InfluenzaA__AHL98542

SEQ ID NO: 164149 - RNA, 1701 nt, Artificial Sequence; identical to SEQ ID NO: 162514
  derived and/or modified sequence opt4 from hemagglutinin__InfluenzaA__AHL98554

SEQ ID NO: 164150 - RNA, 1701 nt, Artificial Sequence; identical to SEQ ID NO: 162388
  derived and/or modified sequence opt4 from hemagglutinin__InfluenzaA__AHL98566

SEQ ID NO: 164151 - RNA, 1701 nt, Artificial Sequence; identical to SEQ ID NO: 162388
  derived and/or modified sequence opt4 from hemagglutinin__InfluenzaA__AHL98578

SEQ ID NO: 164152 - RNA, 1701 nt, Artificial Sequence; identical to SEQ ID NO: 162514
  derived and/or modified sequence opt4 from hemagglutinin__InfluenzaA__AHL98590

SEQ ID NO: 164153 - RNA, 1701 nt, Artificial Sequence; identical to SEQ ID NO: 162378
  derived and/or modified sequence opt4 from hemagglutinin__InfluenzaA__AHL98602

SEQ ID NO: 164154 - RNA, 1701 nt, Artificial Sequence; identical to SEQ ID NO: 162355
  derived and/or modified sequence opt4 from hemagglutinin__InfluenzaA__AHL98614

SEQ ID NO: 164155 - RNA, 1701 nt, Artificial Sequence
  derived and/or modified sequence opt4 from hemagglutinin__InfluenzaA__AHL98626
augaagaccaucaucgcccugagcuacauccugugccugguguucgcccaggagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagagaugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164156 - RNA, 1701 nt, Artificial Sequence; identical to SEQ ID NO: 162378
  derived and/or modified sequence opt4 from hemagglutinin__InfluenzaA__AHL98638

SEQ ID NO: 164157 - RNA, 1701 nt, Artificial Sequence; identical to SEQ ID NO: 162388
  derived and/or modified sequence opt4 from hemagglutinin__InfluenzaA__AHL98650

SEQ ID NO: 164158 - RNA, 1701 nt, Artificial Sequence
  derived and/or modified sequence opt4 from hemagglutinin__InfluenzaA__AHL98662
augaagaccaucaucgcccugagcuacauccugugccugguguucgcccagaagcugcccggcaacgacaacagcaccgccacccugugccugggccaccacgccgugcccaacggcaccauggugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164159 - RNA, 1701 nt, Artificial Sequence; identical to SEQ ID NO: 164026
  derived and/or modified sequence opt4 from hemagglutinin__InfluenzaA__AHL98674

SEQ ID NO: 164160 - RNA, 1701 nt, Artificial Sequence; identical to SEQ ID NO: 162378
  derived and/or modified sequence opt4 from hemagglutinin__InfluenzaA__AHL98686

SEQ ID NO: 164161 - RNA, 1701 nt, Artificial Sequence; identical to SEQ ID NO: 162514
  derived and/or modified sequence opt4 from hemagglutinin__InfluenzaA__AHL98699

SEQ ID NO: 164162 - RNA, 1701 nt, Artificial Sequence; identical to SEQ ID NO: 162643
  derived and/or modified sequence opt4 from hemagglutinin__InfluenzaA__AHL98711

SEQ ID NO: 164163 - RNA, 1701 nt, Artificial Sequence; identical to SEQ ID NO: 162987
  derived and/or modified sequence opt4 from hemagglutinin__InfluenzaA__AHL98722

SEQ ID NO: 164164 - RNA, 1701 nt, Artificial Sequence; identical to SEQ ID NO: 162388
  derived and/or modified sequence opt4 from hemagglutinin__InfluenzaA__AHL98734

SEQ ID NO: 164165 - RNA, 1701 nt, Artificial Sequence; identical to SEQ ID NO: 162514
  derived and/or modified sequence opt4 from hemagglutinin__InfluenzaA__AHL98746

SEQ ID NO: 164166 - RNA, 1701 nt, Artificial Sequence; identical to SEQ ID NO: 162388
  derived and/or modified sequence opt4 from hemagglutinin__InfluenzaA__AHL98758

SEQ ID NO: 164167 - RNA, 1701 nt, Artificial Sequence; identical to SEQ ID NO: 162378
  derived and/or modified sequence opt4 from hemagglutinin__InfluenzaA__AHL98770

SEQ ID NO: 164168 - RNA, 1701 nt, Artificial Sequence; identical to SEQ ID NO: 162517
  derived and/or modified sequence opt4 from hemagglutinin__InfluenzaA__AHL98782

SEQ ID NO: 164169 - RNA, 1701 nt, Artificial Sequence
  derived and/or modified sequence opt4 from hemagglutinin__InfluenzaA__AHL98794
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcagaagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164170 - RNA, 1701 nt, Artificial Sequence
  derived and/or modified sequence opt4 from hemagglutinin__InfluenzaA__AHL98806
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccagaccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164171 - RNA, 1701 nt, Artificial Sequence; identical to SEQ ID NO: 162378
  derived and/or modified sequence opt4 from hemagglutinin__InfluenzaA__AHL98818

SEQ ID NO: 164172 - RNA, 1701 nt, Artificial Sequence; identical to SEQ ID NO: 162388
  derived and/or modified sequence opt4 from hemagglutinin__InfluenzaA__AHL98830

SEQ ID NO: 164173 - RNA, 1701 nt, Artificial Sequence; identical to SEQ ID NO: 162378
  derived and/or modified sequence opt4 from hemagglutinin__InfluenzaA__AHL98842

SEQ ID NO: 164174 - RNA, 1701 nt, Artificial Sequence; identical to SEQ ID NO: 162378
  derived and/or modified sequence opt4 from hemagglutinin__InfluenzaA__AHL98854

SEQ ID NO: 164175 - RNA, 1701 nt, Artificial Sequence
  derived and/or modified sequence opt4 from hemagglutinin__InfluenzaA__AHL98878
augaagaccaucaucgcccugagcuacauccugugccugguguucacccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164176 - RNA, 1701 nt, Artificial Sequence
  derived and/or modified sequence opt4 from hemagglutinin__InfluenzaA__AHL98890
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugccugcugcugugcguggcccugcugggcuucaucaugugggccugccagaagggcaacaucagaugcaacaucugcaucuga

SEQ ID NO: 164177 - RNA, 1701 nt, Artificial Sequence
  derived and/or modified sequence opt4 from hemagglutinin__InfluenzaA__AHL98902
augaagaccaucaucgcccugagcuacauccugugccugguguucgcccagaagcugcccggcaacgacaacagcaccgccacccugugccugggccaccacgccgugcccaacggcaccguggugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164178 - RNA, 1701 nt, Artificial Sequence; identical to SEQ ID NO: 162388
  derived and/or modified sequence opt4 from hemagglutinin__InfluenzaA__AHL98913

SEQ ID NO: 164179 - RNA, 1701 nt, Artificial Sequence; identical to SEQ ID NO: 162378
  derived and/or modified sequence opt4 from hemagglutinin__InfluenzaA__AHL98925

SEQ ID NO: 164180 - RNA, 1701 nt, Artificial Sequence; identical to SEQ ID NO: 162517
  derived and/or modified sequence opt4 from hemagglutinin__InfluenzaA__AHL98937

SEQ ID NO: 164181 - RNA, 1701 nt, Artificial Sequence; identical to SEQ ID NO: 162514
  derived and/or modified sequence opt4 from hemagglutinin__InfluenzaA__AHL98961

SEQ ID NO: 164182 - RNA, 1701 nt, Artificial Sequence
  derived and/or modified sequence opt4 from hemagglutinin__InfluenzaA__AHL98973
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccguggugcccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaugagcugcuuccugcugugcguggcccugcugggcuucaucaugugggccugccagaagggcaacaucagaugcaacaucugcaucuga

SEQ ID NO: 164183 - RNA, 1701 nt, Artificial Sequence
  derived and/or modified sequence opt4 from hemagglutinin__InfluenzaA__AHL98985
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcaccaucaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164184 - RNA, 1701 nt, Artificial Sequence; identical to SEQ ID NO: 162514
  derived and/or modified sequence opt4 from hemagglutinin__InfluenzaA__AHL98997

SEQ ID NO: 164185 - RNA, 1701 nt, Artificial Sequence; identical to SEQ ID NO: 162378
  derived and/or modified sequence opt4 from hemagglutinin__InfluenzaA__AHL99009

SEQ ID NO: 164186 - RNA, 1701 nt, Artificial Sequence; identical to SEQ ID NO: 162388
  derived and/or modified sequence opt4 from hemagglutinin__InfluenzaA__AHL99021

SEQ ID NO: 164187 - RNA, 1701 nt, Artificial Sequence
  derived and/or modified sequence opt4 from hemagglutinin__InfluenzaA__AHL99045
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggccccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164188 - RNA, 1701 nt, Artificial Sequence
  derived and/or modified sequence opt4 from hemagglutinin__InfluenzaA__AHL99057
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagaucaucgacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164189 - RNA, 1701 nt, Artificial Sequence
  derived and/or modified sequence opt4 from hemagglutinin__InfluenzaA__AHL99069
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacacccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164190 - RNA, 1701 nt, Artificial Sequence
  derived and/or modified sequence opt4 from hemagglutinin__InfluenzaA__AHL99081
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagggcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164191 - RNA, 1701 nt, Artificial Sequence
  derived and/or modified sequence opt4 from hemagglutinin__InfluenzaA__AHL99093
augaagaccaucaucgcccugagcuacauccugugccugaucuucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucaagugcaacaucugcaucuga

SEQ ID NO: 164192 - RNA, 1701 nt, Artificial Sequence; identical to SEQ ID NO: 162378
  derived and/or modified sequence opt4 from hemagglutinin__InfluenzaA__AHL99117

SEQ ID NO: 164193 - RNA, 1701 nt, Artificial Sequence
  derived and/or modified sequence opt4 from hemagglutinin__InfluenzaA__AHL99129
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggacaucgagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaucugggccugccagaagggcaacaucagaugcaacaucugcaucuga

SEQ ID NO: 164194 - RNA, 1701 nt, Artificial Sequence
  derived and/or modified sequence opt4 from hemagglutinin__InfluenzaA__AHL99141
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccuggacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164195 - RNA, 1701 nt, Artificial Sequence
  derived and/or modified sequence opt4 from hemagglutinin__InfluenzaA__AHL99153
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugacccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164196 - RNA, 1701 nt, Artificial Sequence; identical to SEQ ID NO: 162517
  derived and/or modified sequence opt4 from hemagglutinin__InfluenzaA__AHL99165

SEQ ID NO: 164197 - RNA, 1701 nt, Artificial Sequence; identical to SEQ ID NO: 163002
  derived and/or modified sequence opt4 from hemagglutinin__InfluenzaA__AHL99177

SEQ ID NO: 164198 - RNA, 1701 nt, Artificial Sequence; identical to SEQ ID NO: 162378
  derived and/or modified sequence opt4 from hemagglutinin__InfluenzaA__AHL99189

SEQ ID NO: 164199 - RNA, 1701 nt, Artificial Sequence; identical to SEQ ID NO: 162514
  derived and/or modified sequence opt4 from hemagglutinin__InfluenzaA__AHL99225

SEQ ID NO: 164200 - RNA, 1701 nt, Artificial Sequence; identical to SEQ ID NO: 162987
  derived and/or modified sequence opt4 from hemagglutinin__InfluenzaA__AHL99237

SEQ ID NO: 164201 - RNA, 1701 nt, Artificial Sequence; identical to SEQ ID NO: 162388
  derived and/or modified sequence opt4 from hemagglutinin__InfluenzaA__AHL99249

SEQ ID NO: 164202 - RNA, 1701 nt, Artificial Sequence; identical to SEQ ID NO: 162378
  derived and/or modified sequence opt4 from hemagglutinin__InfluenzaA__AHL99261

SEQ ID NO: 164203 - RNA, 1701 nt, Artificial Sequence; identical to SEQ ID NO: 162517
  derived and/or modified sequence opt4 from hemagglutinin__InfluenzaA__AHL99273

SEQ ID NO: 164204 - RNA, 1701 nt, Artificial Sequence
  derived and/or modified sequence opt4 from hemagglutinin__InfluenzaA__AHL99285
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164205 - RNA, 1701 nt, Artificial Sequence; identical to SEQ ID NO: 162543
  derived and/or modified sequence opt4 from hemagglutinin__InfluenzaA__AHL99297

SEQ ID NO: 164206 - RNA, 1701 nt, Artificial Sequence; identical to SEQ ID NO: 162388
  derived and/or modified sequence opt4 from hemagglutinin__InfluenzaA__AHL99309

SEQ ID NO: 164207 - RNA, 1701 nt, Artificial Sequence
  derived and/or modified sequence opt4 from hemagglutinin__InfluenzaA__AHL99321
augaagaccaucaucgcccugagcuacauccugugccugguguucacccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164208 - RNA, 1701 nt, Artificial Sequence
  derived and/or modified sequence opt4 from hemagglutinin__InfluenzaA__AHL99333
augaagaccaucaucgcccugagcuacauccugugccugguguucgcccaggagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164209 - RNA, 1701 nt, Artificial Sequence
  derived and/or modified sequence opt4 from hemagglutinin__InfluenzaA__AHL99356
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164210 - RNA, 1701 nt, Artificial Sequence; identical to SEQ ID NO: 162403
  derived and/or modified sequence opt4 from hemagglutinin__InfluenzaA__AHL99367

SEQ ID NO: 164211 - RNA, 1701 nt, Artificial Sequence
  derived and/or modified sequence opt4 from hemagglutinin__InfluenzaA__AHL99379
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcggcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaucagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 164212 - RNA, 1701 nt, Artificial Sequence; identical to SEQ ID NO: 164204
  derived and/or modified sequence opt4 from hemagglutinin__InfluenzaA__AHL99390

SEQ ID NO: 164213 - RNA, 1701 nt, Artificial Sequence; identical to SEQ ID NO: 162378
  derived and/or modified sequence opt4 from hemagglutinin__InfluenzaA__AHL99402

SEQ ID NO: 164214 - RNA, 1701 nt, Artificial Sequence
  derived and/or modified sequence opt4 from hemagglutinin__InfluenzaA__AHL99426
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaugaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164215 - RNA, 1701 nt, Artificial Sequence
  derived and/or modified sequence opt4 from hemagglutinin__InfluenzaA__AHL99438
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164216 - RNA, 1701 nt, Artificial Sequence; identical to SEQ ID NO: 162514
  derived and/or modified sequence opt4 from hemagglutinin__InfluenzaA__AHL99450

SEQ ID NO: 164217 - RNA, 1701 nt, Artificial Sequence; identical to SEQ ID NO: 162987
  derived and/or modified sequence opt4 from hemagglutinin__InfluenzaA__AHL99462

SEQ ID NO: 164218 - RNA, 1701 nt, Artificial Sequence; identical to SEQ ID NO: 162517
  derived and/or modified sequence opt4 from hemagglutinin__InfluenzaA__AHL99474

SEQ ID NO: 164219 - RNA, 1701 nt, Artificial Sequence; identical to SEQ ID NO: 162543
  derived and/or modified sequence opt4 from hemagglutinin__InfluenzaA__AHL99486

SEQ ID NO: 164220 - RNA, 1701 nt, Artificial Sequence; identical to SEQ ID NO: 162514
  derived and/or modified sequence opt4 from hemagglutinin__InfluenzaA__AHL99498

SEQ ID NO: 164221 - RNA, 1701 nt, Artificial Sequence; identical to SEQ ID NO: 162378
  derived and/or modified sequence opt4 from hemagglutinin__InfluenzaA__AHL99510

SEQ ID NO: 164222 - RNA, 1701 nt, Artificial Sequence; identical to SEQ ID NO: 162378
  derived and/or modified sequence opt4 from hemagglutinin__InfluenzaA__AHL99522

SEQ ID NO: 164223 - RNA, 1701 nt, Artificial Sequence; identical to SEQ ID NO: 162403
  derived and/or modified sequence opt4 from hemagglutinin__InfluenzaA__AHL99534

SEQ ID NO: 164224 - RNA, 1701 nt, Artificial Sequence; identical to SEQ ID NO: 162378
  derived and/or modified sequence opt4 from hemagglutinin__InfluenzaA__AHL99546

SEQ ID NO: 164225 - RNA, 1701 nt, Artificial Sequence; identical to SEQ ID NO: 162378
  derived and/or modified sequence opt4 from hemagglutinin__InfluenzaA__AHL99558

SEQ ID NO: 164226 - RNA, 1701 nt, Artificial Sequence
  derived and/or modified sequence opt4 from hemagglutinin__InfluenzaA__AHL99570
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcagcugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacaucaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164227 - RNA, 1701 nt, Artificial Sequence; identical to SEQ ID NO: 162378
  derived and/or modified sequence opt4 from hemagglutinin__InfluenzaA__AHL99582

SEQ ID NO: 164228 - RNA, 1701 nt, Artificial Sequence
  derived and/or modified sequence opt4 from hemagglutinin__InfluenzaA__AHL99594
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcggcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugccccagagccggcgccaagggcuucuacaagaaccugaucuggcuggugaagaagggcaacagcuaccccaagcugagcaucagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 164229 - RNA, 1701 nt, Artificial Sequence; identical to SEQ ID NO: 162987
  derived and/or modified sequence opt4 from hemagglutinin__InfluenzaA__AHL99605

SEQ ID NO: 164230 - RNA, 1701 nt, Artificial Sequence; identical to SEQ ID NO: 162517
  derived and/or modified sequence opt4 from hemagglutinin__InfluenzaA__AHL99617

SEQ ID NO: 164231 - RNA, 1701 nt, Artificial Sequence; identical to SEQ ID NO: 162378
  derived and/or modified sequence opt4 from hemagglutinin__InfluenzaA__AHL99629

SEQ ID NO: 164232 - RNA, 1701 nt, Artificial Sequence
  derived and/or modified sequence opt4 from hemagglutinin__InfluenzaA__AHL99641
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccguggugcccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaugagcugcuuccugcugugcguggcccugcugggcuucaucaugugggccugccagaagggcaacaucagaugcaacaucugcaucuga

SEQ ID NO: 164233 - RNA, 1701 nt, Artificial Sequence
  derived and/or modified sequence opt4 from hemagglutinin__InfluenzaA__AHL99665
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacaucaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164234 - RNA, 1701 nt, Artificial Sequence; identical to SEQ ID NO: 162378
  derived and/or modified sequence opt4 from hemagglutinin__InfluenzaA__AHL99677

SEQ ID NO: 164235 - RNA, 1701 nt, Artificial Sequence; identical to SEQ ID NO: 162378
  derived and/or modified sequence opt4 from hemagglutinin__InfluenzaA__AHL99689

SEQ ID NO: 164236 - RNA, 1701 nt, Artificial Sequence
  derived and/or modified sequence opt4 from hemagglutinin__InfluenzaA__AHL99701
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugacccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164237 - RNA, 1701 nt, Artificial Sequence
  derived and/or modified sequence opt4 from hemagglutinin__InfluenzaA__AHL99713
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacaccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucaccugcuuccugcugugcguggcccugcugggcuucaucaugugggccugccagaagggcaacaucagaugcaacaucugcaucuga

SEQ ID NO: 164238 - RNA, 1701 nt, Artificial Sequence; identical to SEQ ID NO: 162378
  derived and/or modified sequence opt4 from hemagglutinin__InfluenzaA__AHL99725

SEQ ID NO: 164239 - RNA, 1701 nt, Artificial Sequence; identical to SEQ ID NO: 162580
  derived and/or modified sequence opt4 from hemagglutinin__InfluenzaA__AHL99737

SEQ ID NO: 164240 - RNA, 1701 nt, Artificial Sequence; identical to SEQ ID NO: 162378
  derived and/or modified sequence opt4 from hemagglutinin__InfluenzaA__AHL99748

SEQ ID NO: 164241 - RNA, 1701 nt, Artificial Sequence; identical to SEQ ID NO: 162378
  derived and/or modified sequence opt4 from hemagglutinin__InfluenzaA__AHL99760

SEQ ID NO: 164242 - RNA, 1701 nt, Artificial Sequence; identical to SEQ ID NO: 162388
  derived and/or modified sequence opt4 from hemagglutinin__InfluenzaA__AHL99772

SEQ ID NO: 164243 - RNA, 1701 nt, Artificial Sequence; identical to SEQ ID NO: 162403
  derived and/or modified sequence opt4 from hemagglutinin__InfluenzaA__AHL99784

SEQ ID NO: 164244 - RNA, 1701 nt, Artificial Sequence; identical to SEQ ID NO: 162543
  derived and/or modified sequence opt4 from hemagglutinin__InfluenzaA__AHL99796

SEQ ID NO: 164245 - RNA, 1701 nt, Artificial Sequence; identical to SEQ ID NO: 162378
  derived and/or modified sequence opt4 from hemagglutinin__InfluenzaA__AHL99808

SEQ ID NO: 164246 - RNA, 1701 nt, Artificial Sequence
  derived and/or modified sequence opt4 from hemagglutinin__InfluenzaA__AHL99820
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgacggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 164247 - RNA, 1701 nt, Artificial Sequence; identical to SEQ ID NO: 162378
  derived and/or modified sequence opt4 from hemagglutinin__InfluenzaA__AHL99832

SEQ ID NO: 164248 - RNA, 1701 nt, Artificial Sequence; identical to SEQ ID NO: 162403
  derived and/or modified sequence opt4 from hemagglutinin__InfluenzaA__AHL99844

SEQ ID NO: 164249 - RNA, 1701 nt, Artificial Sequence; identical to SEQ ID NO: 162355
  derived and/or modified sequence opt4 from hemagglutinin__InfluenzaA__AHL99856

SEQ ID NO: 164250 - RNA, 1701 nt, Artificial Sequence
  derived and/or modified sequence opt4 from hemagglutinin__InfluenzaA__AHL99868
augaagaccaucaucgcccugagcuacauccugugccugguguucgcccaggagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagaagagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164251 - RNA, 1701 nt, Artificial Sequence; identical to SEQ ID NO: 162517
  derived and/or modified sequence opt4 from hemagglutinin__InfluenzaA__AHL99880

SEQ ID NO: 164252 - RNA, 1701 nt, Artificial Sequence; identical to SEQ ID NO: 162378
  derived and/or modified sequence opt4 from hemagglutinin__InfluenzaA__AHL99892

SEQ ID NO: 164253 - RNA, 1701 nt, Artificial Sequence; identical to SEQ ID NO: 162514
  derived and/or modified sequence opt4 from hemagglutinin__InfluenzaA__AHL99904

SEQ ID NO: 164254 - RNA, 1701 nt, Artificial Sequence
  derived and/or modified sequence opt4 from hemagglutinin__InfluenzaA__AHL99916
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaugagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164255 - RNA, 1701 nt, Artificial Sequence; identical to SEQ ID NO: 162403
  derived and/or modified sequence opt4 from hemagglutinin__InfluenzaA__AHL99928

SEQ ID NO: 164256 - RNA, 1701 nt, Artificial Sequence
  derived and/or modified sequence opt4 from hemagglutinin__InfluenzaA__AHL99940
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcggcguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164257 - RNA, 1701 nt, Artificial Sequence; identical to SEQ ID NO: 162378
  derived and/or modified sequence opt4 from hemagglutinin__InfluenzaA__AHL99952

SEQ ID NO: 164258 - RNA, 1701 nt, Artificial Sequence; identical to SEQ ID NO: 162403
  derived and/or modified sequence opt4 from hemagglutinin__InfluenzaA__AHL99964

SEQ ID NO: 164259 - RNA, 1701 nt, Artificial Sequence; identical to SEQ ID NO: 162403
  derived and/or modified sequence opt4 from hemagglutinin__InfluenzaA__AHL99976

SEQ ID NO: 164260 - RNA, 1701 nt, Artificial Sequence; identical to SEQ ID NO: 162403
  derived and/or modified sequence opt4 from hemagglutinin__InfluenzaA__AHL99988

SEQ ID NO: 164261 - RNA, 1701 nt, Artificial Sequence; identical to SEQ ID NO: 162378
  derived and/or modified sequence opt4 from hemagglutinin__InfluenzaA__AHM00001

SEQ ID NO: 164262 - RNA, 1701 nt, Artificial Sequence; identical to SEQ ID NO: 162378
  derived and/or modified sequence opt4 from hemagglutinin__InfluenzaA__AHM00013

SEQ ID NO: 164263 - RNA, 1701 nt, Artificial Sequence; identical to SEQ ID NO: 162388
  derived and/or modified sequence opt4 from hemagglutinin__InfluenzaA__AHM00025

SEQ ID NO: 164264 - RNA, 1701 nt, Artificial Sequence; identical to SEQ ID NO: 162403
  derived and/or modified sequence opt4 from hemagglutinin__InfluenzaA__AHM00037

SEQ ID NO: 164265 - RNA, 1701 nt, Artificial Sequence; identical to SEQ ID NO: 162403
  derived and/or modified sequence opt4 from hemagglutinin__InfluenzaA__AHM00061

SEQ ID NO: 164266 - RNA, 1701 nt, Artificial Sequence; identical to SEQ ID NO: 162378
  derived and/or modified sequence opt4 from hemagglutinin__InfluenzaA__AHM00073

SEQ ID NO: 164267 - RNA, 1701 nt, Artificial Sequence; identical to SEQ ID NO: 162378
  derived and/or modified sequence opt4 from hemagglutinin__InfluenzaA__AHM00085

SEQ ID NO: 164268 - RNA, 1701 nt, Artificial Sequence
  derived and/or modified sequence opt4 from hemagglutinin__InfluenzaA__AHM00097
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaacagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacaccaccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaugugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164269 - RNA, 1701 nt, Artificial Sequence; identical to SEQ ID NO: 162403
  derived and/or modified sequence opt4 from hemagglutinin__InfluenzaA__AHM00108

SEQ ID NO: 164270 - RNA, 1701 nt, Artificial Sequence; identical to SEQ ID NO: 162403
  derived and/or modified sequence opt4 from hemagglutinin__InfluenzaA__AHM00120

SEQ ID NO: 164271 - RNA, 1701 nt, Artificial Sequence
  derived and/or modified sequence opt4 from hemagglutinin__InfluenzaA__AHM00132
augaagaccaucaucgcccugagcuacauccugugccugguguucgcccaggagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucagccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164272 - RNA, 1701 nt, Artificial Sequence; identical to SEQ ID NO: 162378
  derived and/or modified sequence opt4 from hemagglutinin__InfluenzaA__AHM00144

SEQ ID NO: 164273 - RNA, 1701 nt, Artificial Sequence; identical to SEQ ID NO: 162403
  derived and/or modified sequence opt4 from hemagglutinin__InfluenzaA__AHM00156

SEQ ID NO: 164274 - RNA, 1701 nt, Artificial Sequence; identical to SEQ ID NO: 162378
  derived and/or modified sequence opt4 from hemagglutinin__InfluenzaA__AHM00168

SEQ ID NO: 164275 - RNA, 1701 nt, Artificial Sequence
  derived and/or modified sequence opt4 from hemagglutinin__InfluenzaA__AHM00180
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacaacccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164276 - RNA, 1701 nt, Artificial Sequence; identical to SEQ ID NO: 162355
  derived and/or modified sequence opt4 from hemagglutinin__InfluenzaA__AHM00192

SEQ ID NO: 164277 - RNA, 1701 nt, Artificial Sequence; identical to SEQ ID NO: 162403
  derived and/or modified sequence opt4 from hemagglutinin__InfluenzaA__AHM00204

SEQ ID NO: 164278 - RNA, 1701 nt, Artificial Sequence; identical to SEQ ID NO: 162403
  derived and/or modified sequence opt4 from hemagglutinin__InfluenzaA__AHM00216

SEQ ID NO: 164279 - RNA, 1701 nt, Artificial Sequence; identical to SEQ ID NO: 162378
  derived and/or modified sequence opt4 from hemagglutinin__InfluenzaA__AHM00228

SEQ ID NO: 164280 - RNA, 1701 nt, Artificial Sequence; identical to SEQ ID NO: 162378
  derived and/or modified sequence opt4 from hemagglutinin__InfluenzaA__AHM00240

SEQ ID NO: 164281 - RNA, 1701 nt, Artificial Sequence; identical to SEQ ID NO: 162378
  derived and/or modified sequence opt4 from hemagglutinin__InfluenzaA__AHM00252

SEQ ID NO: 164282 - RNA, 1701 nt, Artificial Sequence; identical to SEQ ID NO: 162378
  derived and/or modified sequence opt4 from hemagglutinin__InfluenzaA__AHM00264

SEQ ID NO: 164283 - RNA, 1701 nt, Artificial Sequence; identical to SEQ ID NO: 162355
  derived and/or modified sequence opt4 from hemagglutinin__InfluenzaA__AHM00276

SEQ ID NO: 164284 - RNA, 1701 nt, Artificial Sequence; identical to SEQ ID NO: 162378
  derived and/or modified sequence opt4 from hemagglutinin__InfluenzaA__AHM00288

SEQ ID NO: 164285 - RNA, 1701 nt, Artificial Sequence; identical to SEQ ID NO: 162378
  derived and/or modified sequence opt4 from hemagglutinin__InfluenzaA__AHM00300

SEQ ID NO: 164286 - RNA, 1701 nt, Artificial Sequence; identical to SEQ ID NO: 162403
  derived and/or modified sequence opt4 from hemagglutinin__InfluenzaA__AHM00312

SEQ ID NO: 164287 - RNA, 1701 nt, Artificial Sequence; identical to SEQ ID NO: 162355
  derived and/or modified sequence opt4 from hemagglutinin__InfluenzaA__AHM00324

SEQ ID NO: 164288 - RNA, 1701 nt, Artificial Sequence; identical to SEQ ID NO: 162355
  derived and/or modified sequence opt4 from hemagglutinin__InfluenzaA__AHM00336

SEQ ID NO: 164289 - RNA, 1701 nt, Artificial Sequence; identical to SEQ ID NO: 162403
  derived and/or modified sequence opt4 from hemagglutinin__InfluenzaA__AHM00348

SEQ ID NO: 164290 - RNA, 1701 nt, Artificial Sequence
  derived and/or modified sequence opt4 from hemagglutinin__InfluenzaA__AHM00360
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164291 - RNA, 1701 nt, Artificial Sequence; identical to SEQ ID NO: 162403
  derived and/or modified sequence opt4 from hemagglutinin__InfluenzaA__AHM00372

SEQ ID NO: 164292 - RNA, 1701 nt, Artificial Sequence; identical to SEQ ID NO: 162403
  derived and/or modified sequence opt4 from hemagglutinin__InfluenzaA__AHM00395

SEQ ID NO: 164293 - RNA, 1701 nt, Artificial Sequence; identical to SEQ ID NO: 162378
  derived and/or modified sequence opt4 from hemagglutinin__InfluenzaA__AHM00407

SEQ ID NO: 164294 - RNA, 1701 nt, Artificial Sequence; identical to SEQ ID NO: 162378
  derived and/or modified sequence opt4 from hemagglutinin__InfluenzaA__AHM00419

SEQ ID NO: 164295 - RNA, 1701 nt, Artificial Sequence; identical to SEQ ID NO: 162378
  derived and/or modified sequence opt4 from hemagglutinin__InfluenzaA__AHM00443

SEQ ID NO: 164296 - RNA, 1701 nt, Artificial Sequence; identical to SEQ ID NO: 162403
  derived and/or modified sequence opt4 from hemagglutinin__InfluenzaA__AHM00455

SEQ ID NO: 164297 - RNA, 1701 nt, Artificial Sequence; identical to SEQ ID NO: 162403
  derived and/or modified sequence opt4 from hemagglutinin__InfluenzaA__AHM00467

SEQ ID NO: 164298 - RNA, 1701 nt, Artificial Sequence; identical to SEQ ID NO: 162403
  derived and/or modified sequence opt4 from hemagglutinin__InfluenzaA__AHM00479

SEQ ID NO: 164299 - RNA, 1701 nt, Artificial Sequence; identical to SEQ ID NO: 162403
  derived and/or modified sequence opt4 from hemagglutinin__InfluenzaA__AHM00491

SEQ ID NO: 164300 - RNA, 1701 nt, Artificial Sequence; identical to SEQ ID NO: 162378
  derived and/or modified sequence opt4 from hemagglutinin__InfluenzaA__AHM00503

SEQ ID NO: 164301 - RNA, 1701 nt, Artificial Sequence; identical to SEQ ID NO: 162378
  derived and/or modified sequence opt4 from hemagglutinin__InfluenzaA__AHM00515

SEQ ID NO: 164302 - RNA, 1701 nt, Artificial Sequence
  derived and/or modified sequence opt4 from hemagglutinin__InfluenzaA__AHM00527
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagccccaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164303 - RNA, 1701 nt, Artificial Sequence; identical to SEQ ID NO: 162355
  derived and/or modified sequence opt4 from hemagglutinin__InfluenzaA__AHM00539

SEQ ID NO: 164304 - RNA, 1701 nt, Artificial Sequence
  derived and/or modified sequence opt4 from hemagglutinin__InfluenzaA__AHM00543
augaagaccaucaucgcccugagcuacauccugugccugguguucgcccaggagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcaccauggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164305 - RNA, 1701 nt, Artificial Sequence; identical to SEQ ID NO: 162378
  derived and/or modified sequence opt4 from hemagglutinin__InfluenzaA__AHM00555

SEQ ID NO: 164306 - RNA, 1701 nt, Artificial Sequence
  derived and/or modified sequence opt4 from hemagglutinin__InfluenzaA__AHM00567
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164307 - RNA, 1701 nt, Artificial Sequence; identical to SEQ ID NO: 162378
  derived and/or modified sequence opt4 from hemagglutinin__InfluenzaA__AHM00579

SEQ ID NO: 164308 - RNA, 1701 nt, Artificial Sequence; identical to SEQ ID NO: 162403
  derived and/or modified sequence opt4 from hemagglutinin__InfluenzaA__AHM00591

SEQ ID NO: 164309 - RNA, 1701 nt, Artificial Sequence; identical to SEQ ID NO: 162378
  derived and/or modified sequence opt4 from hemagglutinin__InfluenzaA__AHM00603

SEQ ID NO: 164310 - RNA, 1701 nt, Artificial Sequence; identical to SEQ ID NO: 162378
  derived and/or modified sequence opt4 from hemagglutinin__InfluenzaA__AHM00615

SEQ ID NO: 164311 - RNA, 1701 nt, Artificial Sequence
  derived and/or modified sequence opt4 from hemagglutinin__InfluenzaA__AHM00627
augaagaccaccaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164312 - RNA, 1701 nt, Artificial Sequence; identical to SEQ ID NO: 162378
  derived and/or modified sequence opt4 from hemagglutinin__InfluenzaA__AHM00639

SEQ ID NO: 164313 - RNA, 1701 nt, Artificial Sequence; identical to SEQ ID NO: 162355
  derived and/or modified sequence opt4 from hemagglutinin__InfluenzaA__AHM00651

SEQ ID NO: 164314 - RNA, 1701 nt, Artificial Sequence; identical to SEQ ID NO: 162514
  derived and/or modified sequence opt4 from hemagglutinin__InfluenzaA__AHM00663

SEQ ID NO: 164315 - RNA, 1701 nt, Artificial Sequence; identical to SEQ ID NO: 162403
  derived and/or modified sequence opt4 from hemagglutinin__InfluenzaA__AHM00675

SEQ ID NO: 164316 - RNA, 1701 nt, Artificial Sequence; identical to SEQ ID NO: 163465
  derived and/or modified sequence opt4 from hemagglutinin__InfluenzaA__AHM00687

SEQ ID NO: 164317 - RNA, 1701 nt, Artificial Sequence
  derived and/or modified sequence opt4 from hemagglutinin__InfluenzaA__AHM00698
augaagaccaucaucgcccugagcuacauccugugccugguguucgcccaggagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaccagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164318 - RNA, 1701 nt, Artificial Sequence; identical to SEQ ID NO: 162378
  derived and/or modified sequence opt4 from hemagglutinin__InfluenzaA__AHM00710

SEQ ID NO: 164319 - RNA, 1701 nt, Artificial Sequence; identical to SEQ ID NO: 162378
  derived and/or modified sequence opt4 from hemagglutinin__InfluenzaA__AHM00722

SEQ ID NO: 164320 - RNA, 1701 nt, Artificial Sequence; identical to SEQ ID NO: 162378
  derived and/or modified sequence opt4 from hemagglutinin__InfluenzaA__AHM00734

SEQ ID NO: 164321 - RNA, 1701 nt, Artificial Sequence; identical to SEQ ID NO: 162513
  derived and/or modified sequence opt4 from hemagglutinin__InfluenzaA__AHM00746

SEQ ID NO: 164322 - RNA, 1701 nt, Artificial Sequence; identical to SEQ ID NO: 162378
  derived and/or modified sequence opt4 from hemagglutinin__InfluenzaA__AHM00758

SEQ ID NO: 164323 - RNA, 1701 nt, Artificial Sequence; identical to SEQ ID NO: 162546
  derived and/or modified sequence opt4 from hemagglutinin__InfluenzaA__AHM00770

SEQ ID NO: 164324 - RNA, 1701 nt, Artificial Sequence; identical to SEQ ID NO: 162355
  derived and/or modified sequence opt4 from hemagglutinin__InfluenzaA__AHM00782

SEQ ID NO: 164325 - RNA, 1701 nt, Artificial Sequence
  derived and/or modified sequence opt4 from hemagglutinin__InfluenzaA__AHM00794
augaagaccaucaucgcccugagcuacauccugugccugguguucacccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164326 - RNA, 1701 nt, Artificial Sequence; identical to SEQ ID NO: 162546
  derived and/or modified sequence opt4 from hemagglutinin__InfluenzaA__AHM00806

SEQ ID NO: 164327 - RNA, 1701 nt, Artificial Sequence
  derived and/or modified sequence opt4 from hemagglutinin__InfluenzaA__AHM00818
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagaacuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164328 - RNA, 1701 nt, Artificial Sequence; identical to SEQ ID NO: 162403
  derived and/or modified sequence opt4 from hemagglutinin__InfluenzaA__AHM00830

SEQ ID NO: 164329 - RNA, 1701 nt, Artificial Sequence; identical to SEQ ID NO: 162403
  derived and/or modified sequence opt4 from hemagglutinin__InfluenzaA__AHM00842

SEQ ID NO: 164330 - RNA, 1701 nt, Artificial Sequence; identical to SEQ ID NO: 164306
  derived and/or modified sequence opt4 from hemagglutinin__InfluenzaA__AHM00854

SEQ ID NO: 164331 - RNA, 1701 nt, Artificial Sequence; identical to SEQ ID NO: 164306
  derived and/or modified sequence opt4 from hemagglutinin__InfluenzaA__AHM00866

SEQ ID NO: 164332 - RNA, 1701 nt, Artificial Sequence; identical to SEQ ID NO: 162378
  derived and/or modified sequence opt4 from hemagglutinin__InfluenzaA__AHM00878

SEQ ID NO: 164333 - RNA, 1701 nt, Artificial Sequence; identical to SEQ ID NO: 162355
  derived and/or modified sequence opt4 from hemagglutinin__InfluenzaA__AHM00890

SEQ ID NO: 164334 - RNA, 1701 nt, Artificial Sequence; identical to SEQ ID NO: 162388
  derived and/or modified sequence opt4 from hemagglutinin__InfluenzaA__AHM00902

SEQ ID NO: 164335 - RNA, 1701 nt, Artificial Sequence; identical to SEQ ID NO: 162378
  derived and/or modified sequence opt4 from hemagglutinin__InfluenzaA__AHM00914

SEQ ID NO: 164336 - RNA, 1701 nt, Artificial Sequence; identical to SEQ ID NO: 162378
  derived and/or modified sequence opt4 from hemagglutinin__InfluenzaA__AHM00926

SEQ ID NO: 164337 - RNA, 1701 nt, Artificial Sequence; identical to SEQ ID NO: 162355
  derived and/or modified sequence opt4 from hemagglutinin__InfluenzaA__AHM00938

SEQ ID NO: 164338 - RNA, 1701 nt, Artificial Sequence
  derived and/or modified sequence opt4 from hemagglutinin__InfluenzaA__AHM00950
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgugagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaugagcugcuuccugcugugcguggcccugcugggcuucaucaugugggccugccagaagggcaacaucagaugcaacaucugcaucuga

SEQ ID NO: 164339 - RNA, 1701 nt, Artificial Sequence; identical to SEQ ID NO: 162355
  derived and/or modified sequence opt4 from hemagglutinin__InfluenzaA__AHM00962

SEQ ID NO: 164340 - RNA, 1701 nt, Artificial Sequence
  derived and/or modified sequence opt4 from hemagglutinin__InfluenzaA__AHM00974
augaagaccaucaucgcccugagcuacauccugugccugguguucgcccaggagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcggcaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164341 - RNA, 1683 nt, Artificial Sequence
  derived and/or modified sequence opt4 from hemagglutinin__InfluenzaA__AHM24224
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaaggaggaggcccugagacagauccugagagagagcggcggcaucgacaaggaggccaugggcuucaccuacagcggcaucagaaccaacggcgccaccagcgccugcagaagaagcggcagcagcuucuacgccgagaugaaguggcugcugagcaacaccgacaacgccgccuucccccagaugaccaagagcuacaagaacaccagaaagagccccgcccugaucguguggggcauccaccacagcgugagcaccgccgagcagaccaagcuguacggcagcggcaacaagcuggugaccgugggcagcagcaacuaccagcagagcuucgugcccagccccggcgccagaccccaggugaacggccugagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagagccgugggcaagugccccagauacgugaagcagagaagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaacgagguggagaagcagaucggcaacgugaucaacuggaccagagacagcaucaccgagguguggagcuacaacgccgagcugcugguggccauggagaaccagcacaccaucgaccuggccgacagcgagauggacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgugaugggccugguguucaucugcgugaagaacggcaacaugagaugcaccaucugcaucuga

SEQ ID NO: 164342 - RNA, 1683 nt, Artificial Sequence; identical to SEQ ID NO: 162508
  derived and/or modified sequence opt4 from hemagglutinin__InfluenzaA__AHM24236

SEQ ID NO: 164343 - RNA, 1683 nt, Artificial Sequence; identical to SEQ ID NO: 162508
  derived and/or modified sequence opt4 from hemagglutinin__InfluenzaA__AHM24248

SEQ ID NO: 164344 - RNA, 1701 nt, Artificial Sequence
  derived and/or modified sequence opt4 from hemagglutinin__InfluenzaA__AHM98309
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagguguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164345 - RNA, 1710 nt, Artificial Sequence
  derived and/or modified sequence opt4 from hemagglutinin__InfluenzaA__AHM98339
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164346 - RNA, 1701 nt, Artificial Sequence
  derived and/or modified sequence opt4 from hemagglutinin__InfluenzaA__AHM98350
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacgccaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164347 - RNA, 1701 nt, Artificial Sequence; identical to SEQ ID NO: 158974
  derived and/or modified sequence opt4 from hemagglutinin__InfluenzaA__AHM98361

SEQ ID NO: 164348 - RNA, 1701 nt, Artificial Sequence; identical to SEQ ID NO: 159387
  derived and/or modified sequence opt4 from hemagglutinin__InfluenzaA__AHM98372

SEQ ID NO: 164349 - RNA, 1701 nt, Artificial Sequence; identical to SEQ ID NO: 159387
  derived and/or modified sequence opt4 from hemagglutinin__InfluenzaA__AHM98383

SEQ ID NO: 164350 - RNA, 1701 nt, Artificial Sequence; identical to SEQ ID NO: 159344
  derived and/or modified sequence opt4 from hemagglutinin__InfluenzaA__AHM98394

SEQ ID NO: 164351 - RNA, 1701 nt, Artificial Sequence
  derived and/or modified sequence opt4 from hemagglutinin__InfluenzaA__AHM98405
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucaagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164352 - RNA, 1701 nt, Artificial Sequence; identical to SEQ ID NO: 164351
  derived and/or modified sequence opt4 from hemagglutinin__InfluenzaA__AHM98416

SEQ ID NO: 164353 - RNA, 1701 nt, Artificial Sequence; identical to SEQ ID NO: 159344
  derived and/or modified sequence opt4 from hemagglutinin__InfluenzaA__AHM98427

SEQ ID NO: 164354 - RNA, 1701 nt, Artificial Sequence; identical to SEQ ID NO: 159562
  derived and/or modified sequence opt4 from hemagglutinin__InfluenzaA__AHM98438

SEQ ID NO: 164355 - RNA, 1701 nt, Artificial Sequence; identical to SEQ ID NO: 160706
  derived and/or modified sequence opt4 from hemagglutinin__InfluenzaA__AHM98449

SEQ ID NO: 164356 - RNA, 1701 nt, Artificial Sequence
  derived and/or modified sequence opt4 from hemagglutinin__InfluenzaA__AHM98460
augaaggccauccugguggugcugcugugcaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacaccaccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164357 - RNA, 1701 nt, Artificial Sequence; identical to SEQ ID NO: 159387
  derived and/or modified sequence opt4 from hemagglutinin__InfluenzaA__AHM98471

SEQ ID NO: 164358 - RNA, 1701 nt, Artificial Sequence
  derived and/or modified sequence opt4 from hemagglutinin__InfluenzaA__AHM98482
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgacaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164359 - RNA, 1701 nt, Artificial Sequence
  derived and/or modified sequence opt4 from hemagglutinin__InfluenzaA__AHM98493
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaaguaccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164360 - RNA, 1701 nt, Artificial Sequence
  derived and/or modified sequence opt4 from hemagglutinin__InfluenzaA__AHM98504
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcaaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164361 - RNA, 1701 nt, Artificial Sequence; identical to SEQ ID NO: 158974
  derived and/or modified sequence opt4 from hemagglutinin__InfluenzaA__AHM98515

SEQ ID NO: 164362 - RNA, 1701 nt, Artificial Sequence
  derived and/or modified sequence opt4 from hemagglutinin__InfluenzaA__AHM98526
augaaggccauccugguggugcugcugcacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugagaagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcugauccugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164363 - RNA, 1701 nt, Artificial Sequence; identical to SEQ ID NO: 158974
  derived and/or modified sequence opt4 from hemagglutinin__InfluenzaA__AHM98537

SEQ ID NO: 164364 - RNA, 1701 nt, Artificial Sequence
  derived and/or modified sequence opt4 from hemagglutinin__InfluenzaA__AHM98548
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccgugaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164365 - RNA, 1701 nt, Artificial Sequence
  derived and/or modified sequence opt4 from hemagglutinin__InfluenzaA__AHM98559
augaaggccauccugguggugcugcuguacaccuucgccaccgccaaggccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164366 - RNA, 1701 nt, Artificial Sequence; identical to SEQ ID NO: 159344
  derived and/or modified sequence opt4 from hemagglutinin__InfluenzaA__AHM98570

SEQ ID NO: 164367 - RNA, 1701 nt, Artificial Sequence
  derived and/or modified sequence opt4 from hemagglutinin__InfluenzaA__AHM98581
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagaagcuggagcuacaucguggagaccagcagcagcgacaacggcaccugcuaccccggcgacuucaucgacuacgaggagcugagagagcagcugagcagcgugagcagcuucaagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164368 - RNA, 1701 nt, Artificial Sequence; identical to SEQ ID NO: 159344
  derived and/or modified sequence opt4 from hemagglutinin__InfluenzaA__AHM98592

SEQ ID NO: 164369 - RNA, 1701 nt, Artificial Sequence; identical to SEQ ID NO: 159387
  derived and/or modified sequence opt4 from hemagglutinin__InfluenzaA__AHM98603

SEQ ID NO: 164370 - RNA, 1701 nt, Artificial Sequence; identical to SEQ ID NO: 158974
  derived and/or modified sequence opt4 from hemagglutinin__InfluenzaA__AHM98614

SEQ ID NO: 164371 - RNA, 1701 nt, Artificial Sequence; identical to SEQ ID NO: 164351
  derived and/or modified sequence opt4 from hemagglutinin__InfluenzaA__AHM98625

SEQ ID NO: 164372 - RNA, 1701 nt, Artificial Sequence; identical to SEQ ID NO: 164351
  derived and/or modified sequence opt4 from hemagglutinin__InfluenzaA__AHM98636

SEQ ID NO: 164373 - RNA, 1701 nt, Artificial Sequence
  derived and/or modified sequence opt4 from hemagglutinin__InfluenzaA__AHM98647
augaaggccauccugguggugcugcuguacaccuucgccaccgccaaggccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164374 - RNA, 1701 nt, Artificial Sequence; identical to SEQ ID NO: 159387
  derived and/or modified sequence opt4 from hemagglutinin__InfluenzaA__AHM98658

SEQ ID NO: 164375 - RNA, 1701 nt, Artificial Sequence; identical to SEQ ID NO: 159344
  derived and/or modified sequence opt4 from hemagglutinin__InfluenzaA__AHM98669

SEQ ID NO: 164376 - RNA, 1701 nt, Artificial Sequence; identical to SEQ ID NO: 160706
  derived and/or modified sequence opt4 from hemagglutinin__InfluenzaA__AHM98701

SEQ ID NO: 164377 - RNA, 1701 nt, Artificial Sequence; identical to SEQ ID NO: 160706
  derived and/or modified sequence opt4 from hemagglutinin__InfluenzaA__AHM98712

SEQ ID NO: 164378 - RNA, 1701 nt, Artificial Sequence
  derived and/or modified sequence opt4 from hemagglutinin__InfluenzaA__AHM98723
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaacugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagauccugcccaagaccagcagcuggcccaaccacgacagcaacaagggcgugaccgccgccugcccccaggccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugaucgagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgcccagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccagauacagcgaggaggccaagcugaacagagaggagaucgacggcgugaagcuggagagcaccagaaucuaccagauccuggccaucuacagcaccguggccagcagccuggugcugaucgugagccugggcgccaucagcuucuggaugugcagcaacggcagccugcagugcagaaucugcaucuga

SEQ ID NO: 164379 - RNA, 1701 nt, Artificial Sequence
  derived and/or modified sequence opt4 from hemagglutinin__InfluenzaA__AHM98734
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagacccugagcaccgccagcagcuggagcuacaucguggagaccagcaacagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcagcaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 164380 - RNA, 1701 nt, Artificial Sequence; identical to SEQ ID NO: 160706
  derived and/or modified sequence opt4 from hemagglutinin__InfluenzaA__AHM98745

SEQ ID NO: 164381 - RNA, 1701 nt, Artificial Sequence
  derived and/or modified sequence opt4 from hemagglutinin__InfluenzaA__AHM98756
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagacccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgugaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 164382 - RNA, 1701 nt, Artificial Sequence; identical to SEQ ID NO: 160706
  derived and/or modified sequence opt4 from hemagglutinin__InfluenzaA__AHM98767

SEQ ID NO: 164383 - RNA, 1701 nt, Artificial Sequence
  derived and/or modified sequence opt4 from hemagglutinin__InfluenzaA__AHM98778
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacagaaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugccccagagccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164384 - RNA, 1701 nt, Artificial Sequence; identical to SEQ ID NO: 159570
  derived and/or modified sequence opt4 from hemagglutinin__InfluenzaA__AHM98798

SEQ ID NO: 164385 - RNA, 1701 nt, Artificial Sequence; identical to SEQ ID NO: 159344
  derived and/or modified sequence opt4 from hemagglutinin__InfluenzaA__AHM98809

SEQ ID NO: 164386 - RNA, 1701 nt, Artificial Sequence; identical to SEQ ID NO: 159344
  derived and/or modified sequence opt4 from hemagglutinin__InfluenzaA__AHM98820

SEQ ID NO: 164387 - RNA, 1701 nt, Artificial Sequence; identical to SEQ ID NO: 159344
  derived and/or modified sequence opt4 from hemagglutinin__InfluenzaA__AHM98831

SEQ ID NO: 164388 - RNA, 1701 nt, Artificial Sequence
  derived and/or modified sequence opt4 from hemagglutinin__InfluenzaA__AHM98836
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggauccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164389 - RNA, 1701 nt, Artificial Sequence
  derived and/or modified sequence opt4 from hemagglutinin__InfluenzaA__AHM98847
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacgacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164390 - RNA, 1701 nt, Artificial Sequence; identical to SEQ ID NO: 159344
  derived and/or modified sequence opt4 from hemagglutinin__InfluenzaA__AHM98858

SEQ ID NO: 164391 - RNA, 1701 nt, Artificial Sequence; identical to SEQ ID NO: 159387
  derived and/or modified sequence opt4 from hemagglutinin__InfluenzaA__AHM98877

SEQ ID NO: 164392 - RNA, 1701 nt, Artificial Sequence
  derived and/or modified sequence opt4 from hemagglutinin__InfluenzaA__AHM98898
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaaccacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164393 - RNA, 1701 nt, Artificial Sequence; identical to SEQ ID NO: 162970
  derived and/or modified sequence opt4 from hemagglutinin__InfluenzaA__AHM98909

SEQ ID NO: 164394 - RNA, 1701 nt, Artificial Sequence
  derived and/or modified sequence opt4 from hemagglutinin__InfluenzaA__AHM98932
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugggcggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcgacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164395 - RNA, 1701 nt, Artificial Sequence; identical to SEQ ID NO: 164394
  derived and/or modified sequence opt4 from hemagglutinin__InfluenzaA__AHM98940

SEQ ID NO: 164396 - RNA, 1701 nt, Artificial Sequence; identical to SEQ ID NO: 164394
  derived and/or modified sequence opt4 from hemagglutinin__InfluenzaA__AHM98951

SEQ ID NO: 164397 - RNA, 1701 nt, Artificial Sequence
  derived and/or modified sequence opt4 from hemagglutinin__InfluenzaA__AHM98975
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgagagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164398 - RNA, 1701 nt, Artificial Sequence
  derived and/or modified sequence opt4 from hemagglutinin__InfluenzaA__AHM98997
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcgacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164399 - RNA, 1701 nt, Artificial Sequence
  derived and/or modified sequence opt4 from hemagglutinin__InfluenzaA__AHM99019
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugaagggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcgacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164400 - RNA, 1701 nt, Artificial Sequence; identical to SEQ ID NO: 164399
  derived and/or modified sequence opt4 from hemagglutinin__InfluenzaA__AHM99031

SEQ ID NO: 164401 - RNA, 1701 nt, Artificial Sequence; identical to SEQ ID NO: 164399
  derived and/or modified sequence opt4 from hemagglutinin__InfluenzaA__AHM99043

SEQ ID NO: 164402 - RNA, 1701 nt, Artificial Sequence; identical to SEQ ID NO: 164399
  derived and/or modified sequence opt4 from hemagglutinin__InfluenzaA__AHM99054

SEQ ID NO: 164403 - RNA, 1701 nt, Artificial Sequence; identical to SEQ ID NO: 164399
  derived and/or modified sequence opt4 from hemagglutinin__InfluenzaA__AHM99065

SEQ ID NO: 164404 - RNA, 1701 nt, Artificial Sequence
  derived and/or modified sequence opt4 from hemagglutinin__InfluenzaA__AHM99075
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcgacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164405 - RNA, 1701 nt, Artificial Sequence
  derived and/or modified sequence opt4 from hemagglutinin__InfluenzaA__AHN00717
augaaggccauccugcuggugcugcugugcaccuucgccgccaccaacgccgacacccugugcaucggcuaccacgccaacaacagcaccgacaccguggacaccgugcuggagaagaacgugaccgugacccacagcgugaaccugcuggaggacagacacaacggcaagcugugcaagcugggcggcaucgccccccugcaccugggcaagugcaacaucgccggcuggcugcugggcaaccccgagugcgagcugcuguucaccgugagcagcuggagcuacaucguggagaccagcaacagcgacaacggcaccugcuaccccggcgacuucaucaacuacgaggagcugagagagcagcugagcagcgugagcagcuucgagagauucgagaucuuccccaagaccagcagcuggcccaaccacgagaccaacagaggcgugaccgccgccugccccuacgccggcgccaacagcuucuacagaaaccugaucuggcuggugaagaagggcaacagcuaccccaagcugagcaagagcuacgugaacaacaagggcaaggaggugcuggugcuguggggcauccaccacccccccaccagcaccgaccagcagagccuguaccagaacgccgacgccuacguguucgugggcagcagcaaguacaacagaaaguucaagcccgagaucgccgccagacccaaggugagaggccaggccggcagaaugaacuacuacuggacccugaucgagcccggcgacaccaucaccuucgaggccaccggcaaccugguggugcccagauacgccuucgccaugaacagaggccccggcagcggcaucaucaucagcgacgcccccgugcacgacugcaacaccaccugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucgacggcaucaccaacaaggugaacagcgugaucaagaagaugaacacccaguucaccgccgugggcaaggaguucaaccaccuggagaagagaaucgagaaccugaacaagaagguggacgacggcuuccuggacguguggaccuacaacgccgagcugcuggugcugcuggagaacgagagaacccuggacuuccacgacagcaacgugaagaaccuguacgagaaggugagaagccagcugagaaacaacgccaaggagaucggcaacggcugcuucgaguucuaccacaagugcgacgacaccugcauggagagcgugaagaacggcaccuacgacuaccccaaguacagcgaggagagcaagcugaacagagaggagaucgacggcgugaagcuggagagcaccagaaucuaccagauccuggccaucuacagcaccgccgccagcagccuggugcugcuggugagccugggcgccaucagcuucuggaugugcagcaacggcagccugcagugcagaaucugcaucuga

SEQ ID NO: 164406 - RNA, 1701 nt, Artificial Sequence
  derived and/or modified sequence opt4 from hemagglutinin__InfluenzaA__AHN00764
augaaggccauccugcuggugcugcugugcaccuucgccgccaccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugggcggcaucgccccccugcaccugggcaagugcaacaucgccggcuggcugcugggcaaccccgagugcgagcugcuguucaccgugagcagcuggagcuacaucguggagaccagcaacagcgacaacggcaccugcuaccccggcgacuucaucaacuacgaggagcugagagagcagcugagcagcgugagcagcuucgagagauucgagaucuuccccaagaccagcagcuggcccaaccacgagaccaacagaggcgugaccgccgccugccccuacgccggcgccaacagcuucuacagaaaccugaucuggcuggugaagaagggcaacagcuaccccaagcugagcaagagcuacgugaacaacaagggcaaggaggugcuggugcuguggggcauccaccacccccccaccagcaccgaccagcagagccuguaccagaacgccgacgccuacguguucgugggcagcagcaaguacaacagaaaguucaagcccgagaucgccgccagacccaaggugagaggccaggccggcagaaugaacuacuacuggacccugaucgagcccggcgacaccaucaccuucgaggccaccggcaaccugguggugcccagauacgccuucgccaugaacagaggccccggcagcggcaucaucaucagcgacgcccccgugcacgacugcaacaccaccugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucgacggcaucaccaacaaggugaacagcgugaucaagaagaugaacacccaguucaccgccgugggcaaggaguucaaccaccuggagaagagaaucgagaaccugaacaagaagguggacgacggcuuccuggacguguggaccuacaacgccgagcugcuggugcugcuggagaacgagagaacccuggacuuccacgacagcaacgugaagaaccuguacgagaaggugagaagccagcugagaaacaacgccaaggagaucggcaacggcugcuucgaguucuaccacaagugcgacgacaccugcauggagagcgugaagaacggcaccuacgacuaccccaaguacagcgaggagagcaagcugaacagagaggagaucgacggcgugaagcuggagagcaccagaaucuaccagauccuggccaucuacagcaccgccgccagcagccuggugcugcuggugagccugggcgccaucagcuucuggaugugcagcaacggcagccugcagugcagaaucugcaucuga

SEQ ID NO: 164407 - RNA, 1683 nt, Artificial Sequence
  derived and/or modified sequence opt4 from hemagglutinin__InfluenzaA__AHN96323
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgccaccagcgccugcagaagaagcggcagcagcuucuacgccgagaugaaguggcugcugagcaacaccgacaacgccgccuucccccagaugaccaagagcuacaagaacaccagaaagagccccgcccugaucguguggggcauccaccacagcgugagcaccgccgagcagaccaagcuguacggcagcggcaacaagcuggugaccgugggcagcagcaacuaccagcagagcuucgugcccagccccggcgccagaccccaggugaacggccugagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagagccgugggcaagugccccagauacgugaagcagagaagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaacgagguggagaagcagaucggcaacgugaucaacuggaccagagacagcaucaccgagguguggagcuacaacgccgagcugcugguggccauggagaaccagcacaccaucgaccuggccgacagcgagauggacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgugaugggccugguguucaucugcgugaagaacggcaacaugagaugcaccaucggcaucuga

SEQ ID NO: 164408 - RNA, 1701 nt, Artificial Sequence; identical to SEQ ID NO: 159502
  derived and/or modified sequence opt4 from hemagglutinin__InfluenzaA__AHN96442

SEQ ID NO: 164409 - RNA, 1701 nt, Artificial Sequence
  derived and/or modified sequence opt4 from hemagglutinin__InfluenzaA__AHN96443
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacaccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164410 - RNA, 1701 nt, Artificial Sequence
  derived and/or modified sequence opt4 from hemagglutinin__InfluenzaA__AHN96444
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaaccagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcaucgagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164411 - RNA, 1701 nt, Artificial Sequence
  derived and/or modified sequence opt4 from hemagglutinin__InfluenzaA__AHN96445
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaaccagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagauccugagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164412 - RNA, 1701 nt, Artificial Sequence
  derived and/or modified sequence opt4 from hemagglutinin__InfluenzaA__AHN96447
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 164413 - RNA, 1701 nt, Artificial Sequence
  derived and/or modified sequence opt4 from hemagglutinin__InfluenzaA__AHV83765
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaccaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164414 - RNA, 1701 nt, Artificial Sequence; identical to SEQ ID NO: 163541
  derived and/or modified sequence opt4 from hemagglutinin__InfluenzaA__AHV83766

SEQ ID NO: 164415 - RNA, 1701 nt, Artificial Sequence; identical to SEQ ID NO: 162560
  derived and/or modified sequence opt4 from hemagglutinin__InfluenzaA__AHV83767

SEQ ID NO: 164416 - RNA, 1701 nt, Artificial Sequence
  derived and/or modified sequence opt4 from hemagglutinin__InfluenzaA__AHV83768
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugcuggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggacagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164417 - RNA, 1701 nt, Artificial Sequence; identical to SEQ ID NO: 163518
  derived and/or modified sequence opt4 from hemagglutinin__InfluenzaA__AHV83770

SEQ ID NO: 164418 - RNA, 1701 nt, Artificial Sequence
  derived and/or modified sequence opt4 from hemagglutinin__InfluenzaA__AHV83771
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164419 - RNA, 1701 nt, Artificial Sequence; identical to SEQ ID NO: 162560
  derived and/or modified sequence opt4 from hemagglutinin__InfluenzaA__AHV83772

SEQ ID NO: 164420 - RNA, 1701 nt, Artificial Sequence; identical to SEQ ID NO: 162560
  derived and/or modified sequence opt4 from hemagglutinin__InfluenzaA__AHV83773

SEQ ID NO: 164421 - RNA, 1701 nt, Artificial Sequence; identical to SEQ ID NO: 162560
  derived and/or modified sequence opt4 from hemagglutinin__InfluenzaA__AHV83774

SEQ ID NO: 164422 - RNA, 1701 nt, Artificial Sequence
  derived and/or modified sequence opt4 from hemagglutinin__InfluenzaA__AHV83775
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164423 - RNA, 1701 nt, Artificial Sequence; identical to SEQ ID NO: 162560
  derived and/or modified sequence opt4 from hemagglutinin__InfluenzaA__AHV83776

SEQ ID NO: 164424 - RNA, 1701 nt, Artificial Sequence
  derived and/or modified sequence opt4 from hemagglutinin__InfluenzaA__AHV83777
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucugcuucuggaugugcagcaacggcagccugcagugcagaaucugcaucuga

SEQ ID NO: 164425 - RNA, 1701 nt, Artificial Sequence
  derived and/or modified sequence opt4 from hemagglutinin__InfluenzaA__AHV83778
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccguguacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164426 - RNA, 1701 nt, Artificial Sequence
  derived and/or modified sequence opt4 from hemagglutinin__InfluenzaA__AHV83779
augaaggccauccugguggugcugcuguacaccuucgccaccaccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaccggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164427 - RNA, 1701 nt, Artificial Sequence
  derived and/or modified sequence opt4 from hemagglutinin__InfluenzaA__AHV83780
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagacagagcuacaucaacgacaagggcaaggaggugcuggugcuguggggcauccaccaccccagcaccaccaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164428 - RNA, 1701 nt, Artificial Sequence; identical to SEQ ID NO: 162560
  derived and/or modified sequence opt4 from hemagglutinin__InfluenzaA__AHV83781

SEQ ID NO: 164429 - RNA, 1701 nt, Artificial Sequence
  derived and/or modified sequence opt4 from hemagglutinin__InfluenzaA__AHV83782
augaaggccauccugguggugcugcuguacacccuggccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggcccccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164430 - RNA, 1701 nt, Artificial Sequence
  derived and/or modified sequence opt4 from hemagglutinin__InfluenzaA__AHV83783
augaaggccauccugguggugcugcuguacaccuucgccaccgccaacgccgacacccugugcaucggcuaccacgccaacaacagcaccgacaccguggacaccgugcuggagaagaacaucaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagacagagcuacaucaacgacaagggcaaggaggugcuggugcuguggggcauccaccaccccagcaccaccaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164431 - RNA, 1701 nt, Artificial Sequence; identical to SEQ ID NO: 162560
  derived and/or modified sequence opt4 from hemagglutinin__InfluenzaA__AHV83784

SEQ ID NO: 164432 - RNA, 1701 nt, Artificial Sequence; identical to SEQ ID NO: 162560
  derived and/or modified sequence opt4 from hemagglutinin__InfluenzaA__AHV83785

SEQ ID NO: 164433 - RNA, 1701 nt, Artificial Sequence; identical to SEQ ID NO: 162560
  derived and/or modified sequence opt4 from hemagglutinin__InfluenzaA__AHV83787

SEQ ID NO: 164434 - RNA, 1701 nt, Artificial Sequence
  derived and/or modified sequence opt4 from hemagglutinin__InfluenzaA__AHV83788
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcgugagcccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucgugaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164435 - RNA, 1701 nt, Artificial Sequence; identical to SEQ ID NO: 164422
  derived and/or modified sequence opt4 from hemagglutinin__InfluenzaA__AHV83789

SEQ ID NO: 164436 - RNA, 1701 nt, Artificial Sequence; identical to SEQ ID NO: 162560
  derived and/or modified sequence opt4 from hemagglutinin__InfluenzaA__AHV83790

SEQ ID NO: 164437 - RNA, 1701 nt, Artificial Sequence; identical to SEQ ID NO: 162560
  derived and/or modified sequence opt4 from hemagglutinin__InfluenzaA__AHV83791

SEQ ID NO: 164438 - RNA, 1701 nt, Artificial Sequence; identical to SEQ ID NO: 162560
  derived and/or modified sequence opt4 from hemagglutinin__InfluenzaA__AHV83792

SEQ ID NO: 164439 - RNA, 1701 nt, Artificial Sequence
  derived and/or modified sequence opt4 from hemagglutinin__InfluenzaA__AHV83793
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagaaguucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggagauccuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164440 - RNA, 1701 nt, Artificial Sequence
  derived and/or modified sequence opt4 from hemagglutinin__InfluenzaA__AHV83794
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164441 - RNA, 1701 nt, Artificial Sequence
  derived and/or modified sequence opt4 from hemagglutinin__InfluenzaA__AHV83795
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcgccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccaagaucuaccagauccuggccaucuacagcaccguggccagcagccuggugcugguggugagccugggcgccaucagcuucuggaugugcagcaacggcagccugcagugcagaaucugcaucuga

SEQ ID NO: 164442 - RNA, 1701 nt, Artificial Sequence; identical to SEQ ID NO: 164440
  derived and/or modified sequence opt4 from hemagglutinin__InfluenzaA__AHV83796

SEQ ID NO: 164443 - RNA, 1701 nt, Artificial Sequence; identical to SEQ ID NO: 162560
  derived and/or modified sequence opt4 from hemagglutinin__InfluenzaA__AHV83798

SEQ ID NO: 164444 - RNA, 1701 nt, Artificial Sequence; identical to SEQ ID NO: 162560
  derived and/or modified sequence opt4 from hemagglutinin__InfluenzaA__AHV83799

SEQ ID NO: 164445 - RNA, 1701 nt, Artificial Sequence
  derived and/or modified sequence opt4 from hemagglutinin__InfluenzaA__AHV83800
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagaagacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164446 - RNA, 1701 nt, Artificial Sequence
  derived and/or modified sequence opt4 from hemagglutinin__InfluenzaA__AHV83801
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccaagaucuaccagauccuggccaucuacagcaccguggccagcagccuggugcugguggugagccugggcgccaucagcuucuggaugugcagcaacggcagccugcagugcagaaucugcaucuga

SEQ ID NO: 164447 - RNA, 1701 nt, Artificial Sequence
  derived and/or modified sequence opt4 from hemagglutinin__InfluenzaA__AHV83802
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagggccuguaccagaacguggacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164448 - RNA, 1701 nt, Artificial Sequence; identical to SEQ ID NO: 162560
  derived and/or modified sequence opt4 from hemagglutinin__InfluenzaA__AHV83803

SEQ ID NO: 164449 - RNA, 1701 nt, Artificial Sequence; identical to SEQ ID NO: 162560
  derived and/or modified sequence opt4 from hemagglutinin__InfluenzaA__AHV83804

SEQ ID NO: 164450 - RNA, 1701 nt, Artificial Sequence; identical to SEQ ID NO: 162560
  derived and/or modified sequence opt4 from hemagglutinin__InfluenzaA__AHV83805

SEQ ID NO: 164451 - RNA, 1701 nt, Artificial Sequence; identical to SEQ ID NO: 164440
  derived and/or modified sequence opt4 from hemagglutinin__InfluenzaA__AHV83806

SEQ ID NO: 164452 - RNA, 1701 nt, Artificial Sequence
  derived and/or modified sequence opt4 from hemagglutinin__InfluenzaA__AHV83807
augaaggccauccugguggugcugcuguacaccuucgccaccgccaacgccgacacccugugcaucggcuaccacgccaacaacagcaccgacaccguggacaccgugcuggagaaggacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164453 - RNA, 1701 nt, Artificial Sequence
  derived and/or modified sequence opt4 from hemagglutinin__InfluenzaA__AHV83808
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgaggccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaugugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164454 - RNA, 1701 nt, Artificial Sequence; identical to SEQ ID NO: 162560
  derived and/or modified sequence opt4 from hemagglutinin__InfluenzaA__AHV83809

SEQ ID NO: 164455 - RNA, 1701 nt, Artificial Sequence; identical to SEQ ID NO: 163541
  derived and/or modified sequence opt4 from hemagglutinin__InfluenzaA__AHV83810

SEQ ID NO: 164456 - RNA, 1701 nt, Artificial Sequence
  derived and/or modified sequence opt4 from hemagglutinin__InfluenzaA__AHV83812
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgaguaccccaaguacagcgaggaggccaagcugaacagagagaagaucgacggcgugaagcuggagagcaccaagaucuaccagauccuggccaucuacagcaccguggccagcagccuggugcugguggugagccugggcgccaucagcuucuggaugugcagcaacggcagccugcagugcagaaucugcaucuga

SEQ ID NO: 164457 - RNA, 1701 nt, Artificial Sequence; identical to SEQ ID NO: 162560
  derived and/or modified sequence opt4 from hemagglutinin__InfluenzaA__AHV83813

SEQ ID NO: 164458 - RNA, 1701 nt, Artificial Sequence
  derived and/or modified sequence opt4 from hemagglutinin__InfluenzaA__AHV83814
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaaaccuggacuaccacgacagcaacgugaagaaccuguacgagaaggugagaaaccagcugaagaccaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164459 - RNA, 1701 nt, Artificial Sequence; identical to SEQ ID NO: 163541
  derived and/or modified sequence opt4 from hemagglutinin__InfluenzaA__AHV83815

SEQ ID NO: 164460 - RNA, 1701 nt, Artificial Sequence; identical to SEQ ID NO: 162560
  derived and/or modified sequence opt4 from hemagglutinin__InfluenzaA__AHV83816

SEQ ID NO: 164461 - RNA, 1701 nt, Artificial Sequence
  derived and/or modified sequence opt4 from hemagglutinin__InfluenzaA__AHV83817
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugguguggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164462 - RNA, 1701 nt, Artificial Sequence; identical to SEQ ID NO: 164440
  derived and/or modified sequence opt4 from hemagglutinin__InfluenzaA__AHV83818

SEQ ID NO: 164463 - RNA, 1701 nt, Artificial Sequence; identical to SEQ ID NO: 164422
  derived and/or modified sequence opt4 from hemagglutinin__InfluenzaA__AHV83819

SEQ ID NO: 164464 - RNA, 1701 nt, Artificial Sequence
  derived and/or modified sequence opt4 from hemagglutinin__InfluenzaA__AHV83821
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcgugagcccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucgugaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacaacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164465 - RNA, 1701 nt, Artificial Sequence
  derived and/or modified sequence opt4 from hemagglutinin__InfluenzaA__AHV83822
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcgugagcccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucgugaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcaucaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164466 - RNA, 1701 nt, Artificial Sequence
  derived and/or modified sequence opt4 from hemagglutinin__InfluenzaA__AHV83823
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagaucagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacaccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164467 - RNA, 1701 nt, Artificial Sequence
  derived and/or modified sequence opt4 from hemagglutinin__InfluenzaA__AHV83824
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagacagagcuacaucaacgacaagggcaaggaggugcuggugcuguggggcauccaccaccccagcaccaccaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaaaccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164468 - RNA, 1701 nt, Artificial Sequence; identical to SEQ ID NO: 164440
  derived and/or modified sequence opt4 from hemagglutinin__InfluenzaA__AHV83825

SEQ ID NO: 164469 - RNA, 1701 nt, Artificial Sequence
  derived and/or modified sequence opt4 from hemagglutinin__InfluenzaA__AHV83826
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacuucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 164470 - RNA, 1701 nt, Artificial Sequence; identical to SEQ ID NO: 162560
  derived and/or modified sequence opt4 from hemagglutinin__InfluenzaA__AHV83827

SEQ ID NO: 164471 - RNA, 1701 nt, Artificial Sequence; identical to SEQ ID NO: 162560
  derived and/or modified sequence opt4 from hemagglutinin__InfluenzaA__AHV83828

SEQ ID NO: 164472 - RNA, 1701 nt, Artificial Sequence
  derived and/or modified sequence opt4 from hemagglutinin__InfluenzaA__AHV83829
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagaucagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164473 - RNA, 1701 nt, Artificial Sequence; identical to SEQ ID NO: 162560
  derived and/or modified sequence opt4 from hemagglutinin__InfluenzaA__AHV83830

SEQ ID NO: 164474 - RNA, 1701 nt, Artificial Sequence
  derived and/or modified sequence opt4 from hemagglutinin__InfluenzaA__AHV83831
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaucgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucgugagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164475 - RNA, 1701 nt, Artificial Sequence; identical to SEQ ID NO: 163523
  derived and/or modified sequence opt4 from hemagglutinin__InfluenzaA__AHV83832

SEQ ID NO: 164476 - RNA, 1701 nt, Artificial Sequence; identical to SEQ ID NO: 162560
  derived and/or modified sequence opt4 from hemagglutinin__InfluenzaA__AHV83833

SEQ ID NO: 164477 - RNA, 1701 nt, Artificial Sequence; identical to SEQ ID NO: 163541
  derived and/or modified sequence opt4 from hemagglutinin__InfluenzaA__AHV83834

SEQ ID NO: 164478 - RNA, 1701 nt, Artificial Sequence
  derived and/or modified sequence opt4 from hemagglutinin__InfluenzaA__AHV83836
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaaggagaacagcuaccccaagcugagacagagcuacaucaacgacaagggcaaggaggugcuggugcuguggggcauccaccaccccagcaccaccaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164479 - RNA, 1701 nt, Artificial Sequence; identical to SEQ ID NO: 164427
  derived and/or modified sequence opt4 from hemagglutinin__InfluenzaA__AHV83837

SEQ ID NO: 164480 - RNA, 1701 nt, Artificial Sequence; identical to SEQ ID NO: 162560
  derived and/or modified sequence opt4 from hemagglutinin__InfluenzaA__AHV83838

SEQ ID NO: 164481 - RNA, 1701 nt, Artificial Sequence; identical to SEQ ID NO: 163523
  derived and/or modified sequence opt4 from hemagglutinin__InfluenzaA__AHV83839

SEQ ID NO: 164482 - RNA, 1701 nt, Artificial Sequence; identical to SEQ ID NO: 163541
  derived and/or modified sequence opt4 from hemagglutinin__InfluenzaA__AHV83840

SEQ ID NO: 164483 - RNA, 1701 nt, Artificial Sequence
  derived and/or modified sequence opt4 from hemagglutinin__InfluenzaA__AHV83841
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagacagagcuacaucaacgacaagggcaaggaggugcuggugcuguggggcauccaccaccccagcaccaccaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacaacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164484 - RNA, 1701 nt, Artificial Sequence; identical to SEQ ID NO: 162560
  derived and/or modified sequence opt4 from hemagglutinin__InfluenzaA__AHV83842

SEQ ID NO: 164485 - RNA, 1701 nt, Artificial Sequence; identical to SEQ ID NO: 162560
  derived and/or modified sequence opt4 from hemagglutinin__InfluenzaA__AHV83843

SEQ ID NO: 164486 - RNA, 1701 nt, Artificial Sequence; identical to SEQ ID NO: 162560
  derived and/or modified sequence opt4 from hemagglutinin__InfluenzaA__AHV83844

SEQ ID NO: 164487 - RNA, 1701 nt, Artificial Sequence
  derived and/or modified sequence opt4 from hemagglutinin__InfluenzaA__AHV83845
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccacccccccaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 164488 - RNA, 1701 nt, Artificial Sequence; identical to SEQ ID NO: 162560
  derived and/or modified sequence opt4 from hemagglutinin__InfluenzaA__AHV83846

SEQ ID NO: 164489 - RNA, 1701 nt, Artificial Sequence; identical to SEQ ID NO: 162560
  derived and/or modified sequence opt4 from hemagglutinin__InfluenzaA__AHV83847

SEQ ID NO: 164490 - RNA, 1701 nt, Artificial Sequence; identical to SEQ ID NO: 162560
  derived and/or modified sequence opt4 from hemagglutinin__InfluenzaA__AHV83848

SEQ ID NO: 164491 - RNA, 1701 nt, Artificial Sequence; identical to SEQ ID NO: 164413
  derived and/or modified sequence opt4 from hemagglutinin__InfluenzaA__AHV83849

SEQ ID NO: 164492 - RNA, 1701 nt, Artificial Sequence
  derived and/or modified sequence opt4 from hemagglutinin__InfluenzaA__AHV83850
augaaggccauccugguggugcugcuguacaccuucgccaccaccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaaggccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164493 - RNA, 1701 nt, Artificial Sequence; identical to SEQ ID NO: 162560
  derived and/or modified sequence opt4 from hemagglutinin__InfluenzaA__AHV83851

SEQ ID NO: 164494 - RNA, 1701 nt, Artificial Sequence; identical to SEQ ID NO: 162560
  derived and/or modified sequence opt4 from hemagglutinin__InfluenzaA__AHV83852

SEQ ID NO: 164495 - RNA, 1701 nt, Artificial Sequence
  derived and/or modified sequence opt4 from hemagglutinin__InfluenzaA__AHV83853
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagacccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaacccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 164496 - RNA, 1701 nt, Artificial Sequence; identical to SEQ ID NO: 164422
  derived and/or modified sequence opt4 from hemagglutinin__InfluenzaA__AHV83855

SEQ ID NO: 164497 - RNA, 1701 nt, Artificial Sequence
  derived and/or modified sequence opt4 from hemagglutinin__InfluenzaA__AHV83856
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagaucgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164498 - RNA, 1701 nt, Artificial Sequence; identical to SEQ ID NO: 164422
  derived and/or modified sequence opt4 from hemagglutinin__InfluenzaA__AHV83857

SEQ ID NO: 164499 - RNA, 1701 nt, Artificial Sequence
  derived and/or modified sequence opt4 from hemagglutinin__InfluenzaA__AHV83858
augaaggccauccugguggugcugcuguacaccuucgccaccgccaacaccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164500 - RNA, 1701 nt, Artificial Sequence; identical to SEQ ID NO: 162560
  derived and/or modified sequence opt4 from hemagglutinin__InfluenzaA__AHV83859

SEQ ID NO: 164501 - RNA, 1701 nt, Artificial Sequence
  derived and/or modified sequence opt4 from hemagglutinin__InfluenzaA__AHV83861
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164502 - RNA, 1701 nt, Artificial Sequence; identical to SEQ ID NO: 164501
  derived and/or modified sequence opt4 from hemagglutinin__InfluenzaA__AHV83862

SEQ ID NO: 164503 - RNA, 1701 nt, Artificial Sequence; identical to SEQ ID NO: 162560
  derived and/or modified sequence opt4 from hemagglutinin__InfluenzaA__AHV83863

SEQ ID NO: 164504 - RNA, 1701 nt, Artificial Sequence; identical to SEQ ID NO: 162560
  derived and/or modified sequence opt4 from hemagglutinin__InfluenzaA__AHV83864

SEQ ID NO: 164505 - RNA, 1701 nt, Artificial Sequence
  derived and/or modified sequence opt4 from hemagglutinin__InfluenzaA__AHV83866
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccauccacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacgacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164506 - RNA, 1701 nt, Artificial Sequence
  derived and/or modified sequence opt4 from hemagglutinin__InfluenzaA__AHV83867
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacgacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164507 - RNA, 1701 nt, Artificial Sequence; identical to SEQ ID NO: 162560
  derived and/or modified sequence opt4 from hemagglutinin__InfluenzaA__AHV83868

SEQ ID NO: 164508 - RNA, 1701 nt, Artificial Sequence
  derived and/or modified sequence opt4 from hemagglutinin__InfluenzaA__AHV83869
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccaacagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164509 - RNA, 1701 nt, Artificial Sequence; identical to SEQ ID NO: 162560
  derived and/or modified sequence opt4 from hemagglutinin__InfluenzaA__AHV83870

SEQ ID NO: 164510 - RNA, 1701 nt, Artificial Sequence; identical to SEQ ID NO: 162560
  derived and/or modified sequence opt4 from hemagglutinin__InfluenzaA__AHV83871

SEQ ID NO: 164511 - RNA, 1701 nt, Artificial Sequence; identical to SEQ ID NO: 162560
  derived and/or modified sequence opt4 from hemagglutinin__InfluenzaA__AHV83872

SEQ ID NO: 164512 - RNA, 1701 nt, Artificial Sequence
  derived and/or modified sequence opt4 from hemagglutinin__InfluenzaA__AHV83873
augaaggccauccugguggugcugcuguacaccuucgccaccaccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccguggccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164513 - RNA, 1701 nt, Artificial Sequence; identical to SEQ ID NO: 162560
  derived and/or modified sequence opt4 from hemagglutinin__InfluenzaA__AHV83874

SEQ ID NO: 164514 - RNA, 1701 nt, Artificial Sequence; identical to SEQ ID NO: 162560
  derived and/or modified sequence opt4 from hemagglutinin__InfluenzaA__AHV83875

SEQ ID NO: 164515 - RNA, 1701 nt, Artificial Sequence; identical to SEQ ID NO: 162560
  derived and/or modified sequence opt4 from hemagglutinin__InfluenzaA__AHV83876

SEQ ID NO: 164516 - RNA, 1701 nt, Artificial Sequence
  derived and/or modified sequence opt4 from hemagglutinin__InfluenzaA__AHV83877
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucaagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164517 - RNA, 1701 nt, Artificial Sequence; identical to SEQ ID NO: 164427
  derived and/or modified sequence opt4 from hemagglutinin__InfluenzaA__AHV83878

SEQ ID NO: 164518 - RNA, 1701 nt, Artificial Sequence; identical to SEQ ID NO: 164427
  derived and/or modified sequence opt4 from hemagglutinin__InfluenzaA__AHV83879

SEQ ID NO: 164519 - RNA, 1701 nt, Artificial Sequence
  derived and/or modified sequence opt4 from hemagglutinin__InfluenzaA__AHV83881
augaaggccacccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164520 - RNA, 1701 nt, Artificial Sequence; identical to SEQ ID NO: 163541
  derived and/or modified sequence opt4 from hemagglutinin__InfluenzaA__AHV83882

SEQ ID NO: 164521 - RNA, 1701 nt, Artificial Sequence; identical to SEQ ID NO: 163523
  derived and/or modified sequence opt4 from hemagglutinin__InfluenzaA__AHV83883

SEQ ID NO: 164522 - RNA, 1701 nt, Artificial Sequence; identical to SEQ ID NO: 162560
  derived and/or modified sequence opt4 from hemagglutinin__InfluenzaA__AHV83884

SEQ ID NO: 164523 - RNA, 1701 nt, Artificial Sequence
  derived and/or modified sequence opt4 from hemagglutinin__InfluenzaA__AHV83885
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccguguacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164524 - RNA, 1701 nt, Artificial Sequence; identical to SEQ ID NO: 164440
  derived and/or modified sequence opt4 from hemagglutinin__InfluenzaA__AHV83887

SEQ ID NO: 164525 - RNA, 1701 nt, Artificial Sequence; identical to SEQ ID NO: 162560
  derived and/or modified sequence opt4 from hemagglutinin__InfluenzaA__AHV83888

SEQ ID NO: 164526 - RNA, 1701 nt, Artificial Sequence
  derived and/or modified sequence opt4 from hemagglutinin__InfluenzaA__AHV83889
augaaggccauccugguggugcugcugcacacccuggccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164527 - RNA, 1701 nt, Artificial Sequence; identical to SEQ ID NO: 162560
  derived and/or modified sequence opt4 from hemagglutinin__InfluenzaA__AHV83890

SEQ ID NO: 164528 - RNA, 1701 nt, Artificial Sequence; identical to SEQ ID NO: 162560
  derived and/or modified sequence opt4 from hemagglutinin__InfluenzaA__AHV83891

SEQ ID NO: 164529 - RNA, 1701 nt, Artificial Sequence; identical to SEQ ID NO: 162560
  derived and/or modified sequence opt4 from hemagglutinin__InfluenzaA__AHV83893

SEQ ID NO: 164530 - RNA, 1701 nt, Artificial Sequence; identical to SEQ ID NO: 162560
  derived and/or modified sequence opt4 from hemagglutinin__InfluenzaA__AHV83894

SEQ ID NO: 164531 - RNA, 1701 nt, Artificial Sequence
  derived and/or modified sequence opt4 from hemagglutinin__InfluenzaA__AHV83895
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggagaccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164532 - RNA, 1701 nt, Artificial Sequence; identical to SEQ ID NO: 162560
  derived and/or modified sequence opt4 from hemagglutinin__InfluenzaA__AHV83896

SEQ ID NO: 164533 - RNA, 1701 nt, Artificial Sequence; identical to SEQ ID NO: 162560
  derived and/or modified sequence opt4 from hemagglutinin__InfluenzaA__AHV83897

SEQ ID NO: 164534 - RNA, 1701 nt, Artificial Sequence
  derived and/or modified sequence opt4 from hemagglutinin__InfluenzaA__AHV83898
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggugaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164535 - RNA, 1701 nt, Artificial Sequence; identical to SEQ ID NO: 162560
  derived and/or modified sequence opt4 from hemagglutinin__InfluenzaA__AHV83899

SEQ ID NO: 164536 - RNA, 1701 nt, Artificial Sequence; identical to SEQ ID NO: 162560
  derived and/or modified sequence opt4 from hemagglutinin__InfluenzaA__AHV83900

SEQ ID NO: 164537 - RNA, 1701 nt, Artificial Sequence; identical to SEQ ID NO: 162560
  derived and/or modified sequence opt4 from hemagglutinin__InfluenzaA__AHV83901

SEQ ID NO: 164538 - RNA, 1701 nt, Artificial Sequence; identical to SEQ ID NO: 162560
  derived and/or modified sequence opt4 from hemagglutinin__InfluenzaA__AHV83902

SEQ ID NO: 164539 - RNA, 1701 nt, Artificial Sequence; identical to SEQ ID NO: 162560
  derived and/or modified sequence opt4 from hemagglutinin__InfluenzaA__AHV83903

SEQ ID NO: 164540 - RNA, 1701 nt, Artificial Sequence; identical to SEQ ID NO: 162560
  derived and/or modified sequence opt4 from hemagglutinin__InfluenzaA__AHV83904

SEQ ID NO: 164541 - RNA, 1701 nt, Artificial Sequence
  derived and/or modified sequence opt4 from hemagglutinin__InfluenzaA__AHV83905
augaaggccauccugguggugcugcuguacacccugaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164542 - RNA, 1701 nt, Artificial Sequence; identical to SEQ ID NO: 162560
  derived and/or modified sequence opt4 from hemagglutinin__InfluenzaA__AHV83906

SEQ ID NO: 164543 - RNA, 1701 nt, Artificial Sequence; identical to SEQ ID NO: 162560
  derived and/or modified sequence opt4 from hemagglutinin__InfluenzaA__AHV83907

SEQ ID NO: 164544 - RNA, 1701 nt, Artificial Sequence
  derived and/or modified sequence opt4 from hemagglutinin__InfluenzaA__AHV83908
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagccccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaagaaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164545 - RNA, 1701 nt, Artificial Sequence
  derived and/or modified sequence opt4 from hemagglutinin__InfluenzaA__AHV83911
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagccccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164546 - RNA, 1701 nt, Artificial Sequence; identical to SEQ ID NO: 162560
  derived and/or modified sequence opt4 from hemagglutinin__InfluenzaA__AHV83912

SEQ ID NO: 164547 - RNA, 1701 nt, Artificial Sequence; identical to SEQ ID NO: 162560
  derived and/or modified sequence opt4 from hemagglutinin__InfluenzaA__AHV83913

SEQ ID NO: 164548 - RNA, 1701 nt, Artificial Sequence; identical to SEQ ID NO: 162560
  derived and/or modified sequence opt4 from hemagglutinin__InfluenzaA__AHV83915

SEQ ID NO: 164549 - RNA, 1701 nt, Artificial Sequence; identical to SEQ ID NO: 162560
  derived and/or modified sequence opt4 from hemagglutinin__InfluenzaA__AHV83916

SEQ ID NO: 164550 - RNA, 1701 nt, Artificial Sequence; identical to SEQ ID NO: 164545
  derived and/or modified sequence opt4 from hemagglutinin__InfluenzaA__AHV83917

SEQ ID NO: 164551 - RNA, 1701 nt, Artificial Sequence; identical to SEQ ID NO: 163523
  derived and/or modified sequence opt4 from hemagglutinin__InfluenzaA__AHV83919

SEQ ID NO: 164552 - RNA, 1701 nt, Artificial Sequence; identical to SEQ ID NO: 164440
  derived and/or modified sequence opt4 from hemagglutinin__InfluenzaA__AHV83920

SEQ ID NO: 164553 - RNA, 1701 nt, Artificial Sequence; identical to SEQ ID NO: 163541
  derived and/or modified sequence opt4 from hemagglutinin__InfluenzaA__AHV83921

SEQ ID NO: 164554 - RNA, 1701 nt, Artificial Sequence
  derived and/or modified sequence opt4 from hemagglutinin__InfluenzaA__AHV83922
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucagccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164555 - RNA, 1701 nt, Artificial Sequence; identical to SEQ ID NO: 164456
  derived and/or modified sequence opt4 from hemagglutinin__InfluenzaA__AHV83923

SEQ ID NO: 164556 - RNA, 1701 nt, Artificial Sequence; identical to SEQ ID NO: 164440
  derived and/or modified sequence opt4 from hemagglutinin__InfluenzaA__AHV83924

SEQ ID NO: 164557 - RNA, 1701 nt, Artificial Sequence; identical to SEQ ID NO: 164456
  derived and/or modified sequence opt4 from hemagglutinin__InfluenzaA__AHV83925

SEQ ID NO: 164558 - RNA, 1701 nt, Artificial Sequence; identical to SEQ ID NO: 164440
  derived and/or modified sequence opt4 from hemagglutinin__InfluenzaA__AHV83926

SEQ ID NO: 164559 - RNA, 1701 nt, Artificial Sequence; identical to SEQ ID NO: 164545
  derived and/or modified sequence opt4 from hemagglutinin__InfluenzaA__AHV83927

SEQ ID NO: 164560 - RNA, 1701 nt, Artificial Sequence
  derived and/or modified sequence opt4 from hemagglutinin__InfluenzaA__AHV83928
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164561 - RNA, 1701 nt, Artificial Sequence; identical to SEQ ID NO: 164440
  derived and/or modified sequence opt4 from hemagglutinin__InfluenzaA__AHV83929

SEQ ID NO: 164562 - RNA, 1701 nt, Artificial Sequence
  derived and/or modified sequence opt4 from hemagglutinin__InfluenzaA__AHV83930
augaaggccauccuggugauccugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164563 - RNA, 1701 nt, Artificial Sequence; identical to SEQ ID NO: 164440
  derived and/or modified sequence opt4 from hemagglutinin__InfluenzaA__AHV83931

SEQ ID NO: 164564 - RNA, 1701 nt, Artificial Sequence; identical to SEQ ID NO: 162560
  derived and/or modified sequence opt4 from hemagglutinin__InfluenzaA__AHV83932

SEQ ID NO: 164565 - RNA, 1701 nt, Artificial Sequence
  derived and/or modified sequence opt4 from hemagglutinin__InfluenzaA__AHV83933
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcgugaccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggcccuguacagcaccguggccagcagccuggugcugguggugagccugggcgccaucagcuucuggaugugcagcaacggcagccugcagugcagaaucugcaucuga

SEQ ID NO: 164566 - RNA, 1701 nt, Artificial Sequence; identical to SEQ ID NO: 163523
  derived and/or modified sequence opt4 from hemagglutinin__InfluenzaA__AHV83934

SEQ ID NO: 164567 - RNA, 1701 nt, Artificial Sequence; identical to SEQ ID NO: 162560
  derived and/or modified sequence opt4 from hemagglutinin__InfluenzaA__AHV83935

SEQ ID NO: 164568 - RNA, 1701 nt, Artificial Sequence; identical to SEQ ID NO: 162560
  derived and/or modified sequence opt4 from hemagglutinin__InfluenzaA__AHV83937

SEQ ID NO: 164569 - RNA, 1701 nt, Artificial Sequence
  derived and/or modified sequence opt4 from hemagglutinin__InfluenzaA__AHV83938
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagaucagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164570 - RNA, 1701 nt, Artificial Sequence; identical to SEQ ID NO: 164569
  derived and/or modified sequence opt4 from hemagglutinin__InfluenzaA__AHV83939

SEQ ID NO: 164571 - RNA, 1701 nt, Artificial Sequence
  derived and/or modified sequence opt4 from hemagglutinin__InfluenzaA__AHV83940
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuucauggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacagagugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164572 - RNA, 1701 nt, Artificial Sequence; identical to SEQ ID NO: 162560
  derived and/or modified sequence opt4 from hemagglutinin__InfluenzaA__AHV83941

SEQ ID NO: 164573 - RNA, 1701 nt, Artificial Sequence
  derived and/or modified sequence opt4 from hemagglutinin__InfluenzaA__AHV83943
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaugugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164574 - RNA, 1701 nt, Artificial Sequence
  derived and/or modified sequence opt4 from hemagglutinin__InfluenzaA__AHV83944
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacgagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164575 - RNA, 1701 nt, Artificial Sequence
  derived and/or modified sequence opt4 from hemagglutinin__InfluenzaA__AHV83945
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164576 - RNA, 1701 nt, Artificial Sequence
  derived and/or modified sequence opt4 from hemagglutinin__InfluenzaA__AHV83947
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccgugaagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164577 - RNA, 1701 nt, Artificial Sequence; identical to SEQ ID NO: 162560
  derived and/or modified sequence opt4 from hemagglutinin__InfluenzaA__AHV83948

SEQ ID NO: 164578 - RNA, 1701 nt, Artificial Sequence; identical to SEQ ID NO: 162560
  derived and/or modified sequence opt4 from hemagglutinin__InfluenzaA__AHV83949

SEQ ID NO: 164579 - RNA, 1701 nt, Artificial Sequence; identical to SEQ ID NO: 162560
  derived and/or modified sequence opt4 from hemagglutinin__InfluenzaA__AHV83950

SEQ ID NO: 164580 - RNA, 1701 nt, Artificial Sequence
  derived and/or modified sequence opt4 from hemagglutinin__InfluenzaA__AHV83953
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggaccugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164581 - RNA, 1701 nt, Artificial Sequence; identical to SEQ ID NO: 164412
  derived and/or modified sequence opt4 from hemagglutinin__InfluenzaA__AHV83954

SEQ ID NO: 164582 - RNA, 1701 nt, Artificial Sequence
  derived and/or modified sequence opt4 from hemagglutinin__InfluenzaA__AHV83956
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagaacuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcaggagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164583 - RNA, 1701 nt, Artificial Sequence
  derived and/or modified sequence opt4 from hemagglutinin__InfluenzaA__AHZ13523
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacgccugcaagagaggcagcgugaacagcuucuucagcagacugaacuggcuguacaagagcgagagcaaguaccccgugcugaacgugaccaugcccaacaacggcaaguucgacaagcuguacaucuggggcgugcaccaccccagcaccgacaaggagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcuacgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 164584 - RNA, 1698 nt, Artificial Sequence; identical to SEQ ID NO: 156136
  derived and/or modified sequence opt4 from hemagglutinin__InfluenzaA__AHZ13582

SEQ ID NO: 164585 - RNA, 1701 nt, Artificial Sequence
  derived and/or modified sequence opt4 from hemagglutinin__InfluenzaA__AHZ35584
augaagaccaucaucgcccugagcuacauccugugccugaucuucgcccaggagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacgacuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164586 - RNA, 1701 nt, Artificial Sequence
  derived and/or modified sequence opt4 from hemagglutinin__InfluenzaA__AHZ35608
augaagaccaucaucgcccugagcuacauccugugccugaucuucgcccaggagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacgacuuccagaacaaggagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcaccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164587 - RNA, 1701 nt, Artificial Sequence; identical to SEQ ID NO: 164585
  derived and/or modified sequence opt4 from hemagglutinin__InfluenzaA__AHZ35620

SEQ ID NO: 164588 - RNA, 1701 nt, Artificial Sequence; identical to SEQ ID NO: 164585
  derived and/or modified sequence opt4 from hemagglutinin__InfluenzaA__AHZ35632

SEQ ID NO: 164589 - RNA, 1701 nt, Artificial Sequence; identical to SEQ ID NO: 164585
  derived and/or modified sequence opt4 from hemagglutinin__InfluenzaA__AHZ35644

SEQ ID NO: 164590 - RNA, 1701 nt, Artificial Sequence; identical to SEQ ID NO: 164585
  derived and/or modified sequence opt4 from hemagglutinin__InfluenzaA__AHZ35656

SEQ ID NO: 164591 - RNA, 1701 nt, Artificial Sequence; identical to SEQ ID NO: 164585
  derived and/or modified sequence opt4 from hemagglutinin__InfluenzaA__AHZ35668

SEQ ID NO: 164592 - RNA, 1701 nt, Artificial Sequence; identical to SEQ ID NO: 164586
  derived and/or modified sequence opt4 from hemagglutinin__InfluenzaA__AHZ35680

SEQ ID NO: 164593 - RNA, 1701 nt, Artificial Sequence; identical to SEQ ID NO: 164585
  derived and/or modified sequence opt4 from hemagglutinin__InfluenzaA__AHZ35692

SEQ ID NO: 164594 - RNA, 1701 nt, Artificial Sequence; identical to SEQ ID NO: 164585
  derived and/or modified sequence opt4 from hemagglutinin__InfluenzaA__AHZ35716

SEQ ID NO: 164595 - RNA, 1701 nt, Artificial Sequence; identical to SEQ ID NO: 164586
  derived and/or modified sequence opt4 from hemagglutinin__InfluenzaA__AHZ35728

SEQ ID NO: 164596 - RNA, 1701 nt, Artificial Sequence; identical to SEQ ID NO: 164585
  derived and/or modified sequence opt4 from hemagglutinin__InfluenzaA__AHZ35740

SEQ ID NO: 164597 - RNA, 1701 nt, Artificial Sequence; identical to SEQ ID NO: 164585
  derived and/or modified sequence opt4 from hemagglutinin__InfluenzaA__AHZ35752

SEQ ID NO: 164598 - RNA, 1701 nt, Artificial Sequence; identical to SEQ ID NO: 164585
  derived and/or modified sequence opt4 from hemagglutinin__InfluenzaA__AHZ35764

SEQ ID NO: 164599 - RNA, 1701 nt, Artificial Sequence; identical to SEQ ID NO: 164585
  derived and/or modified sequence opt4 from hemagglutinin__InfluenzaA__AHZ35776

SEQ ID NO: 164600 - RNA, 1701 nt, Artificial Sequence
  derived and/or modified sequence opt4 from hemagglutinin__InfluenzaA__AHZ35823
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164601 - RNA, 1701 nt, Artificial Sequence; identical to SEQ ID NO: 164600
  derived and/or modified sequence opt4 from hemagglutinin__InfluenzaA__AHZ35834

SEQ ID NO: 164602 - RNA, 1701 nt, Artificial Sequence; identical to SEQ ID NO: 164600
  derived and/or modified sequence opt4 from hemagglutinin__InfluenzaA__AHZ35845

SEQ ID NO: 164603 - RNA, 1701 nt, Artificial Sequence; identical to SEQ ID NO: 164600
  derived and/or modified sequence opt4 from hemagglutinin__InfluenzaA__AHZ35856

SEQ ID NO: 164604 - RNA, 1701 nt, Artificial Sequence
  derived and/or modified sequence opt4 from hemagglutinin__InfluenzaA__AHZ35867
augaagaccaacaucgcccugagcuacauccugugccuggugagcgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggugcuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164605 - RNA, 1701 nt, Artificial Sequence
  derived and/or modified sequence opt4 from hemagglutinin__InfluenzaA__AHZ35879
augaagaccaacaucgcccugagcuacauccugugccuggugagcgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164606 - RNA, 1701 nt, Artificial Sequence; identical to SEQ ID NO: 164600
  derived and/or modified sequence opt4 from hemagglutinin__InfluenzaA__AHZ35891

SEQ ID NO: 164607 - RNA, 1701 nt, Artificial Sequence; identical to SEQ ID NO: 164600
  derived and/or modified sequence opt4 from hemagglutinin__InfluenzaA__AHZ35902

SEQ ID NO: 164608 - RNA, 1710 nt, Artificial Sequence
  derived and/or modified sequence opt4 from hemagglutinin__InfluenzaA__AHZ35913
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagagagugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164609 - RNA, 1701 nt, Artificial Sequence
  derived and/or modified sequence opt4 from hemagglutinin__InfluenzaA__AHZ35924
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccaggccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcacccagagcagaggccuguucggcgccaucgccggcuucaucgagggcggcuggaccggcaugguggacggcugguacggcuaccaccaccagaacgcccagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164610 - RNA, 1701 nt, Artificial Sequence
  derived and/or modified sequence opt4 from hemagglutinin__InfluenzaA__AHZ35935
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164611 - RNA, 1701 nt, Artificial Sequence; identical to SEQ ID NO: 164605
  derived and/or modified sequence opt4 from hemagglutinin__InfluenzaA__AHZ35946

SEQ ID NO: 164612 - RNA, 1701 nt, Artificial Sequence; identical to SEQ ID NO: 164600
  derived and/or modified sequence opt4 from hemagglutinin__InfluenzaA__AHZ35958

SEQ ID NO: 164613 - RNA, 1701 nt, Artificial Sequence; identical to SEQ ID NO: 164600
  derived and/or modified sequence opt4 from hemagglutinin__InfluenzaA__AHZ35980

SEQ ID NO: 164614 - RNA, 1701 nt, Artificial Sequence; identical to SEQ ID NO: 164600
  derived and/or modified sequence opt4 from hemagglutinin__InfluenzaA__AHZ35991

SEQ ID NO: 164615 - RNA, 1701 nt, Artificial Sequence; identical to SEQ ID NO: 164600
  derived and/or modified sequence opt4 from hemagglutinin__InfluenzaA__AHZ36002

SEQ ID NO: 164616 - RNA, 1701 nt, Artificial Sequence
  derived and/or modified sequence opt4 from hemagglutinin__InfluenzaA__AHZ36013
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacagaaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164617 - RNA, 1701 nt, Artificial Sequence
  derived and/or modified sequence opt4 from hemagglutinin__InfluenzaA__AHZ36024
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaccuaccagauccuggccaucuacagcaccguggccagcagccuggugcugguggugagccugggcgccaucagcuucuggaugugcagcaacggcagccugcagugcagaaucugcaucuga

SEQ ID NO: 164618 - RNA, 1701 nt, Artificial Sequence
  derived and/or modified sequence opt4 from hemagglutinin__InfluenzaA__AHZ36035
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcugauccagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164619 - RNA, 1701 nt, Artificial Sequence; identical to SEQ ID NO: 159375
  derived and/or modified sequence opt4 from hemagglutinin__InfluenzaA__AHZ36047

SEQ ID NO: 164620 - RNA, 1701 nt, Artificial Sequence; identical to SEQ ID NO: 164600
  derived and/or modified sequence opt4 from hemagglutinin__InfluenzaA__AHZ36059

SEQ ID NO: 164621 - RNA, 1701 nt, Artificial Sequence; identical to SEQ ID NO: 164617
  derived and/or modified sequence opt4 from hemagglutinin__InfluenzaA__AHZ36070

SEQ ID NO: 164622 - RNA, 1701 nt, Artificial Sequence; identical to SEQ ID NO: 164616
  derived and/or modified sequence opt4 from hemagglutinin__InfluenzaA__AHZ36081

SEQ ID NO: 164623 - RNA, 1701 nt, Artificial Sequence; identical to SEQ ID NO: 164617
  derived and/or modified sequence opt4 from hemagglutinin__InfluenzaA__AHZ36092

SEQ ID NO: 164624 - RNA, 1701 nt, Artificial Sequence; identical to SEQ ID NO: 164600
  derived and/or modified sequence opt4 from hemagglutinin__InfluenzaA__AHZ36103

SEQ ID NO: 164625 - RNA, 1701 nt, Artificial Sequence; identical to SEQ ID NO: 164617
  derived and/or modified sequence opt4 from hemagglutinin__InfluenzaA__AHZ36114

SEQ ID NO: 164626 - RNA, 1701 nt, Artificial Sequence; identical to SEQ ID NO: 164600
  derived and/or modified sequence opt4 from hemagglutinin__InfluenzaA__AHZ36125

SEQ ID NO: 164627 - RNA, 1701 nt, Artificial Sequence; identical to SEQ ID NO: 164600
  derived and/or modified sequence opt4 from hemagglutinin__InfluenzaA__AHZ36136

SEQ ID NO: 164628 - RNA, 1701 nt, Artificial Sequence; identical to SEQ ID NO: 159375
  derived and/or modified sequence opt4 from hemagglutinin__InfluenzaA__AHZ36147

SEQ ID NO: 164629 - RNA, 1701 nt, Artificial Sequence
  derived and/or modified sequence opt4 from hemagglutinin__InfluenzaA__AHZ36158
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaccagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164630 - RNA, 1701 nt, Artificial Sequence; identical to SEQ ID NO: 164600
  derived and/or modified sequence opt4 from hemagglutinin__InfluenzaA__AHZ36169

SEQ ID NO: 164631 - RNA, 1701 nt, Artificial Sequence
  derived and/or modified sequence opt4 from hemagglutinin__InfluenzaA__AHZ36180
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccauccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164632 - RNA, 1701 nt, Artificial Sequence; identical to SEQ ID NO: 164605
  derived and/or modified sequence opt4 from hemagglutinin__InfluenzaA__AHZ36191

SEQ ID NO: 164633 - RNA, 1701 nt, Artificial Sequence; identical to SEQ ID NO: 159375
  derived and/or modified sequence opt4 from hemagglutinin__InfluenzaA__AHZ36203

SEQ ID NO: 164634 - RNA, 1701 nt, Artificial Sequence; identical to SEQ ID NO: 164600
  derived and/or modified sequence opt4 from hemagglutinin__InfluenzaA__AHZ36215

SEQ ID NO: 164635 - RNA, 1701 nt, Artificial Sequence; identical to SEQ ID NO: 159375
  derived and/or modified sequence opt4 from hemagglutinin__InfluenzaA__AHZ36226

SEQ ID NO: 164636 - RNA, 1701 nt, Artificial Sequence; identical to SEQ ID NO: 164600
  derived and/or modified sequence opt4 from hemagglutinin__InfluenzaA__AHZ36238

SEQ ID NO: 164637 - RNA, 1701 nt, Artificial Sequence; identical to SEQ ID NO: 164600
  derived and/or modified sequence opt4 from hemagglutinin__InfluenzaA__AHZ36249

SEQ ID NO: 164638 - RNA, 1701 nt, Artificial Sequence
  derived and/or modified sequence opt4 from hemagglutinin__InfluenzaA__AHZ36260
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccuucagcagcgacaacggcaccugcuaccccggcgacuucaucaacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164639 - RNA, 1701 nt, Artificial Sequence; identical to SEQ ID NO: 164585
  derived and/or modified sequence opt4 from hemagglutinin__InfluenzaA__AHZ36271

SEQ ID NO: 164640 - RNA, 1701 nt, Artificial Sequence; identical to SEQ ID NO: 164600
  derived and/or modified sequence opt4 from hemagglutinin__InfluenzaA__AHZ36283

SEQ ID NO: 164641 - RNA, 1701 nt, Artificial Sequence; identical to SEQ ID NO: 164585
  derived and/or modified sequence opt4 from hemagglutinin__InfluenzaA__AHZ36294

SEQ ID NO: 164642 - RNA, 1701 nt, Artificial Sequence
  derived and/or modified sequence opt4 from hemagglutinin__InfluenzaA__AHZ36306
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaagaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164643 - RNA, 1701 nt, Artificial Sequence; identical to SEQ ID NO: 164600
  derived and/or modified sequence opt4 from hemagglutinin__InfluenzaA__AHZ36317

SEQ ID NO: 164644 - RNA, 1701 nt, Artificial Sequence; identical to SEQ ID NO: 164600
  derived and/or modified sequence opt4 from hemagglutinin__InfluenzaA__AHZ36328

SEQ ID NO: 164645 - RNA, 1701 nt, Artificial Sequence
  derived and/or modified sequence opt4 from hemagglutinin__InfluenzaA__AHZ36339
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccgugaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagagaagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164646 - RNA, 1701 nt, Artificial Sequence
  derived and/or modified sequence opt4 from hemagglutinin__InfluenzaA__AHZ36362
augaaggccauccugguggugcugcuguacaccuucgccaucgccaacgccgacacccugugcaucggcuaccacgccaacaacagcaccgacaccguggacaccgugcuggagaagaacgugaccgugacccacagcaucaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccgugaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagagaagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164647 - RNA, 1701 nt, Artificial Sequence
  derived and/or modified sequence opt4 from hemagglutinin__InfluenzaA__AHZ36385
augaagaccaucaucgcccugagcuacauccugugccugaucuucgcccaggagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacgacuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauucaagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164648 - RNA, 1701 nt, Artificial Sequence
  derived and/or modified sequence opt4 from hemagglutinin__InfluenzaA__AHZ36397
augaagaccaucaucgcccugagcuacauccugugccugaucuucgcccaggagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacgacuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauucaagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164649 - RNA, 1701 nt, Artificial Sequence; identical to SEQ ID NO: 164585
  derived and/or modified sequence opt4 from hemagglutinin__InfluenzaA__AHZ36409

SEQ ID NO: 164650 - RNA, 1701 nt, Artificial Sequence; identical to SEQ ID NO: 164586
  derived and/or modified sequence opt4 from hemagglutinin__InfluenzaA__AHZ36433

SEQ ID NO: 164651 - RNA, 1701 nt, Artificial Sequence
  derived and/or modified sequence opt4 from hemagglutinin__InfluenzaA__AHZ36445
augaagaccaucaucgcccugagcuacauccugugccugaucuucgcccaggagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacgacuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacgacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164652 - RNA, 1701 nt, Artificial Sequence; identical to SEQ ID NO: 164585
  derived and/or modified sequence opt4 from hemagglutinin__InfluenzaA__AHZ36457

SEQ ID NO: 164653 - RNA, 1701 nt, Artificial Sequence; identical to SEQ ID NO: 164585
  derived and/or modified sequence opt4 from hemagglutinin__InfluenzaA__AHZ36469

SEQ ID NO: 164654 - RNA, 1701 nt, Artificial Sequence
  derived and/or modified sequence opt4 from hemagglutinin__InfluenzaA__AHZ36481
augaagaccaucaucgcccugagcuacauccugugccugaucuucgcccaggagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacgacuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164655 - RNA, 1701 nt, Artificial Sequence; identical to SEQ ID NO: 164586
  derived and/or modified sequence opt4 from hemagglutinin__InfluenzaA__AHZ36493

SEQ ID NO: 164656 - RNA, 1701 nt, Artificial Sequence; identical to SEQ ID NO: 164586
  derived and/or modified sequence opt4 from hemagglutinin__InfluenzaA__AHZ36505

SEQ ID NO: 164657 - RNA, 1701 nt, Artificial Sequence; identical to SEQ ID NO: 164586
  derived and/or modified sequence opt4 from hemagglutinin__InfluenzaA__AHZ36517

SEQ ID NO: 164658 - RNA, 1701 nt, Artificial Sequence
  derived and/or modified sequence opt4 from hemagglutinin__InfluenzaA__AHZ36529
augaagaccaucaucgcccugagcuacauccugugccugaucuucgcccaggagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacgacuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcagcugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164659 - RNA, 1701 nt, Artificial Sequence; identical to SEQ ID NO: 164585
  derived and/or modified sequence opt4 from hemagglutinin__InfluenzaA__AHZ36541

SEQ ID NO: 164660 - RNA, 1701 nt, Artificial Sequence
  derived and/or modified sequence opt4 from hemagglutinin__InfluenzaA__AHZ36553
augaagaccaucaucgcccugagcuacauccugugccugaucuucgcccaggagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacgacuuccagaacaaggagugggaccuguucguggagagaagcaaggcccacagcaacugcuaccccuacgacgugcccgacuacgccagccugagaagccugguggccagcagcggcacccuggaguucaagaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcaccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164661 - RNA, 1701 nt, Artificial Sequence; identical to SEQ ID NO: 164585
  derived and/or modified sequence opt4 from hemagglutinin__InfluenzaA__AHZ36565

SEQ ID NO: 164662 - RNA, 1701 nt, Artificial Sequence; identical to SEQ ID NO: 164585
  derived and/or modified sequence opt4 from hemagglutinin__InfluenzaA__AHZ36577

SEQ ID NO: 164663 - RNA, 1701 nt, Artificial Sequence; identical to SEQ ID NO: 164585
  derived and/or modified sequence opt4 from hemagglutinin__InfluenzaA__AHZ36589

SEQ ID NO: 164664 - RNA, 1701 nt, Artificial Sequence; identical to SEQ ID NO: 164660
  derived and/or modified sequence opt4 from hemagglutinin__InfluenzaA__AHZ36601

SEQ ID NO: 164665 - RNA, 1701 nt, Artificial Sequence
  derived and/or modified sequence opt4 from hemagglutinin__InfluenzaA__AHZ36613
augaagaccaucaucgcccugagcuacauccugugccugaucuucgcccaggagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacgacuuccagaacaaggagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcaccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaccagcugcuuccugcugugcguggcccugcugggcuucaucaugugggccugccagaagggcaacaucagaugcaacaucugcaucuga

SEQ ID NO: 164666 - RNA, 1701 nt, Artificial Sequence; identical to SEQ ID NO: 164585
  derived and/or modified sequence opt4 from hemagglutinin__InfluenzaA__AHZ36625

SEQ ID NO: 164667 - RNA, 1701 nt, Artificial Sequence; identical to SEQ ID NO: 164586
  derived and/or modified sequence opt4 from hemagglutinin__InfluenzaA__AHZ36637

SEQ ID NO: 164668 - RNA, 1701 nt, Artificial Sequence; identical to SEQ ID NO: 164586
  derived and/or modified sequence opt4 from hemagglutinin__InfluenzaA__AHZ36649

SEQ ID NO: 164669 - RNA, 1701 nt, Artificial Sequence; identical to SEQ ID NO: 162514
  derived and/or modified sequence opt4 from hemagglutinin__InfluenzaA__AHZ36661

SEQ ID NO: 164670 - RNA, 1701 nt, Artificial Sequence; identical to SEQ ID NO: 162514
  derived and/or modified sequence opt4 from hemagglutinin__InfluenzaA__AHZ36673

SEQ ID NO: 164671 - RNA, 1701 nt, Artificial Sequence
  derived and/or modified sequence opt4 from hemagglutinin__InfluenzaA__AHZ36685
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagagaguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164672 - RNA, 1683 nt, Artificial Sequence; identical to SEQ ID NO: 162508
  derived and/or modified sequence opt4 from hemagglutinin__InfluenzaA__AHZ39698

SEQ ID NO: 164673 - RNA, 1683 nt, Artificial Sequence
  derived and/or modified sequence opt4 from hemagglutinin__InfluenzaA__AHZ39722
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccgacggcgccaccagcgccugcagaagaagcggcagcagcuucuacgccgagaugaaguggcugcugagcaacaccgacgacgccgccuucccccagaugaccaagagcuacaagaacaccagaaagagccccgcccugaucguguggggcauccaccacagcgugagcaccgccgagcagaccaagcuguacggcagcggcaacaagcuggugaccgugggcagcagcaacuaccagcagagcuucgugcccagccccggcgccagaccccaggugaacggccugagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagagccgugggcaagugccccagauacgugaagcagagaagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaacgagguggagaagcagaucggcaacgugaucaacuggaccagagacagcaucaccgagguguggagcuacaacgccgagcugcugguggccauggagaaccagcacaccaucgaccuggccgacagcgagauggacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgugaugggccugguguucaucugcgugaagaacggcaacaugagaugcaccaucugcaucuga

SEQ ID NO: 164674 - RNA, 1683 nt, Artificial Sequence; identical to SEQ ID NO: 164673
  derived and/or modified sequence opt4 from hemagglutinin__InfluenzaA__AHZ39734

SEQ ID NO: 164675 - RNA, 1683 nt, Artificial Sequence
  derived and/or modified sequence opt4 from hemagglutinin__InfluenzaA__AHZ39746
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgccaccagcgccugcagaagaagcggcagcagcuucuacgccgagaugaaguggcugcugagcaacaccgacaacgccgccuucccccagaugaccaagagcuacaagaacaccagaaagagccccgcccugaucguguggggcauccaccacagcgugagcaccgccgagcagaccaagcuguacggcagcggcaacaagcuggugaccgugggcagcagcaacuaccagcagagcuucgugcccagccccggcgagagaccccaggugaacggccugagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagagccgugggcaagugccccagauacgugaagcagagaagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaacgagguggagaagcagaucggcaacgugaucaacuggaccagagacagcaucaccgagguguggagcuacaacgccgagcugcugguggccauggagaaccagcacaccaucgaccuggccgacagcgagauggacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgugaugggccugguguucaucugcgugaagaacggcaacaugagaugcaccaucugcaucuga

SEQ ID NO: 164676 - RNA, 1683 nt, Artificial Sequence; identical to SEQ ID NO: 164673
  derived and/or modified sequence opt4 from hemagglutinin__InfluenzaA__AHZ39758

SEQ ID NO: 164677 - RNA, 1683 nt, Artificial Sequence; identical to SEQ ID NO: 164673
  derived and/or modified sequence opt4 from hemagglutinin__InfluenzaA__AHZ39770

SEQ ID NO: 164678 - RNA, 1683 nt, Artificial Sequence; identical to SEQ ID NO: 164673
  derived and/or modified sequence opt4 from hemagglutinin__InfluenzaA__AHZ39782

SEQ ID NO: 164679 - RNA, 1701 nt, Artificial Sequence; identical to SEQ ID NO: 162403
  derived and/or modified sequence opt4 from hemagglutinin__InfluenzaA__AHZ39794

SEQ ID NO: 164680 - RNA, 1701 nt, Artificial Sequence; identical to SEQ ID NO: 162517
  derived and/or modified sequence opt4 from hemagglutinin__InfluenzaA__AHZ39806

SEQ ID NO: 164681 - RNA, 1701 nt, Artificial Sequence
  derived and/or modified sequence opt4 from hemagglutinin__InfluenzaA__AHZ39818
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaccuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugaucguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 164682 - RNA, 1701 nt, Artificial Sequence; identical to SEQ ID NO: 162403
  derived and/or modified sequence opt4 from hemagglutinin__InfluenzaA__AHZ39841

SEQ ID NO: 164683 - RNA, 1701 nt, Artificial Sequence; identical to SEQ ID NO: 162423
  derived and/or modified sequence opt4 from hemagglutinin__InfluenzaA__AHZ39853

SEQ ID NO: 164684 - RNA, 1701 nt, Artificial Sequence; identical to SEQ ID NO: 162403
  derived and/or modified sequence opt4 from hemagglutinin__InfluenzaA__AHZ39865

SEQ ID NO: 164685 - RNA, 1701 nt, Artificial Sequence
  derived and/or modified sequence opt4 from hemagglutinin__InfluenzaA__AHZ39877
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaccagcugcuuccugcugugcguggcccugcugggcuucaucaugugggccugccagaagggcaacaucagaugcaacaucugcaucuga

SEQ ID NO: 164686 - RNA, 1701 nt, Artificial Sequence; identical to SEQ ID NO: 162423
  derived and/or modified sequence opt4 from hemagglutinin__InfluenzaA__AHZ39889

SEQ ID NO: 164687 - RNA, 1701 nt, Artificial Sequence; identical to SEQ ID NO: 162404
  derived and/or modified sequence opt4 from hemagglutinin__InfluenzaA__AHZ39913

SEQ ID NO: 164688 - RNA, 1701 nt, Artificial Sequence
  derived and/or modified sequence opt4 from hemagglutinin__InfluenzaA__AHZ39925
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164689 - RNA, 1701 nt, Artificial Sequence; identical to SEQ ID NO: 162403
  derived and/or modified sequence opt4 from hemagglutinin__InfluenzaA__AHZ39937

SEQ ID NO: 164690 - RNA, 1701 nt, Artificial Sequence; identical to SEQ ID NO: 162403
  derived and/or modified sequence opt4 from hemagglutinin__InfluenzaA__AHZ39949

SEQ ID NO: 164691 - RNA, 1701 nt, Artificial Sequence; identical to SEQ ID NO: 162403
  derived and/or modified sequence opt4 from hemagglutinin__InfluenzaA__AHZ39961

SEQ ID NO: 164692 - RNA, 1701 nt, Artificial Sequence; identical to SEQ ID NO: 162403
  derived and/or modified sequence opt4 from hemagglutinin__InfluenzaA__AHZ39973

SEQ ID NO: 164693 - RNA, 1701 nt, Artificial Sequence
  derived and/or modified sequence opt4 from hemagglutinin__InfluenzaA__AHZ39985
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgccagcaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaccagcugcuuccugcugugcguggcccugcugggcuucaucaugugggccugccagaagggcaacaucagaugcaacaucugcaucuga

SEQ ID NO: 164694 - RNA, 1701 nt, Artificial Sequence; identical to SEQ ID NO: 162403
  derived and/or modified sequence opt4 from hemagglutinin__InfluenzaA__AHZ39997

SEQ ID NO: 164695 - RNA, 1701 nt, Artificial Sequence
  derived and/or modified sequence opt4 from hemagglutinin__InfluenzaA__AHZ40009
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaucagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164696 - RNA, 1701 nt, Artificial Sequence; identical to SEQ ID NO: 162403
  derived and/or modified sequence opt4 from hemagglutinin__InfluenzaA__AHZ40021

SEQ ID NO: 164697 - RNA, 1701 nt, Artificial Sequence; identical to SEQ ID NO: 162378
  derived and/or modified sequence opt4 from hemagglutinin__InfluenzaA__AHZ40033

SEQ ID NO: 164698 - RNA, 1701 nt, Artificial Sequence; identical to SEQ ID NO: 162403
  derived and/or modified sequence opt4 from hemagglutinin__InfluenzaA__AHZ40045

SEQ ID NO: 164699 - RNA, 1701 nt, Artificial Sequence; identical to SEQ ID NO: 162403
  derived and/or modified sequence opt4 from hemagglutinin__InfluenzaA__AHZ40060

SEQ ID NO: 164700 - RNA, 1701 nt, Artificial Sequence; identical to SEQ ID NO: 162403
  derived and/or modified sequence opt4 from hemagglutinin__InfluenzaA__AHZ40072

SEQ ID NO: 164701 - RNA, 1701 nt, Artificial Sequence; identical to SEQ ID NO: 162403
  derived and/or modified sequence opt4 from hemagglutinin__InfluenzaA__AHZ40084

SEQ ID NO: 164702 - RNA, 1701 nt, Artificial Sequence; identical to SEQ ID NO: 162403
  derived and/or modified sequence opt4 from hemagglutinin__InfluenzaA__AHZ40096

SEQ ID NO: 164703 - RNA, 1701 nt, Artificial Sequence; identical to SEQ ID NO: 162404
  derived and/or modified sequence opt4 from hemagglutinin__InfluenzaA__AHZ40108

SEQ ID NO: 164704 - RNA, 1701 nt, Artificial Sequence; identical to SEQ ID NO: 162517
  derived and/or modified sequence opt4 from hemagglutinin__InfluenzaA__AHZ40120

SEQ ID NO: 164705 - RNA, 1701 nt, Artificial Sequence
  derived and/or modified sequence opt4 from hemagglutinin__InfluenzaA__AHZ40130
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaagaacuggauccuguggaucagcuucgccaucagcugcuuccugcugugcguggcccugcugggcuucaucaugugggccugccagaagggcaacaucagaugcaacaucugcaucuga

SEQ ID NO: 164706 - RNA, 1701 nt, Artificial Sequence
  derived and/or modified sequence opt4 from hemagglutinin__InfluenzaA__AHZ40142
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccaggacaagaagugggaccuguucguggagagaagcaaggccuacagcaacugcuaccccuacgacgugcccgacuacgccagccugagaagccugguggccagcagcggcacccuggaguucaacaacgagaacuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacagacccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164707 - RNA, 1701 nt, Artificial Sequence
  derived and/or modified sequence opt4 from hemagglutinin__InfluenzaA__AHZ40154
augaagaccaucaucgcccugagcuacauccugugccugggcuucgcccaggagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacaugcugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcaacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164708 - RNA, 1701 nt, Artificial Sequence
  derived and/or modified sequence opt4 from hemagglutinin__InfluenzaA__AHZ40166
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcagaugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164709 - RNA, 1701 nt, Artificial Sequence; identical to SEQ ID NO: 162403
  derived and/or modified sequence opt4 from hemagglutinin__InfluenzaA__AHZ40177

SEQ ID NO: 164710 - RNA, 1701 nt, Artificial Sequence; identical to SEQ ID NO: 162403
  derived and/or modified sequence opt4 from hemagglutinin__InfluenzaA__AHZ40189

SEQ ID NO: 164711 - RNA, 1701 nt, Artificial Sequence; identical to SEQ ID NO: 162403
  derived and/or modified sequence opt4 from hemagglutinin__InfluenzaA__AHZ40201

SEQ ID NO: 164712 - RNA, 1701 nt, Artificial Sequence; identical to SEQ ID NO: 162388
  derived and/or modified sequence opt4 from hemagglutinin__InfluenzaA__AHZ40213

SEQ ID NO: 164713 - RNA, 1701 nt, Artificial Sequence; identical to SEQ ID NO: 162355
  derived and/or modified sequence opt4 from hemagglutinin__InfluenzaA__AHZ40225

SEQ ID NO: 164714 - RNA, 1701 nt, Artificial Sequence
  derived and/or modified sequence opt4 from hemagglutinin__InfluenzaA__AHZ40237
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaccgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164715 - RNA, 1701 nt, Artificial Sequence; identical to SEQ ID NO: 162411
  derived and/or modified sequence opt4 from hemagglutinin__InfluenzaA__AHZ40249

SEQ ID NO: 164716 - RNA, 1701 nt, Artificial Sequence; identical to SEQ ID NO: 162378
  derived and/or modified sequence opt4 from hemagglutinin__InfluenzaA__AHZ40261

SEQ ID NO: 164717 - RNA, 1701 nt, Artificial Sequence; identical to SEQ ID NO: 162517
  derived and/or modified sequence opt4 from hemagglutinin__InfluenzaA__AHZ40273

SEQ ID NO: 164718 - RNA, 1701 nt, Artificial Sequence
  derived and/or modified sequence opt4 from hemagglutinin__InfluenzaA__AHZ40285
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcgacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagagcgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacacccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164719 - RNA, 1701 nt, Artificial Sequence; identical to SEQ ID NO: 162514
  derived and/or modified sequence opt4 from hemagglutinin__InfluenzaA__AHZ40297

SEQ ID NO: 164720 - RNA, 1701 nt, Artificial Sequence
  derived and/or modified sequence opt4 from hemagglutinin__InfluenzaA__AHZ40309
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 164721 - RNA, 1701 nt, Artificial Sequence; identical to SEQ ID NO: 162403
  derived and/or modified sequence opt4 from hemagglutinin__InfluenzaA__AHZ40321

SEQ ID NO: 164722 - RNA, 1701 nt, Artificial Sequence; identical to SEQ ID NO: 162403
  derived and/or modified sequence opt4 from hemagglutinin__InfluenzaA__AHZ40333

SEQ ID NO: 164723 - RNA, 1701 nt, Artificial Sequence
  derived and/or modified sequence opt4 from hemagglutinin__InfluenzaA__AHZ40345
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccagcgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164724 - RNA, 1701 nt, Artificial Sequence; identical to SEQ ID NO: 162404
  derived and/or modified sequence opt4 from hemagglutinin__InfluenzaA__AHZ40357

SEQ ID NO: 164725 - RNA, 1701 nt, Artificial Sequence
  derived and/or modified sequence opt4 from hemagglutinin__InfluenzaA__AHZ40369
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcagaagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164726 - RNA, 1701 nt, Artificial Sequence; identical to SEQ ID NO: 162514
  derived and/or modified sequence opt4 from hemagglutinin__InfluenzaA__AHZ40381

SEQ ID NO: 164727 - RNA, 1701 nt, Artificial Sequence; identical to SEQ ID NO: 162403
  derived and/or modified sequence opt4 from hemagglutinin__InfluenzaA__AHZ40393

SEQ ID NO: 164728 - RNA, 1701 nt, Artificial Sequence; identical to SEQ ID NO: 162403
  derived and/or modified sequence opt4 from hemagglutinin__InfluenzaA__AHZ40405

SEQ ID NO: 164729 - RNA, 1701 nt, Artificial Sequence; identical to SEQ ID NO: 162403
  derived and/or modified sequence opt4 from hemagglutinin__InfluenzaA__AHZ40417

SEQ ID NO: 164730 - RNA, 1701 nt, Artificial Sequence
  derived and/or modified sequence opt4 from hemagglutinin__InfluenzaA__AHZ40429
augaagaccaucaucgcccugagcuacauccugugccugguguucgcccaggagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaagaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164731 - RNA, 1701 nt, Artificial Sequence; identical to SEQ ID NO: 162403
  derived and/or modified sequence opt4 from hemagglutinin__InfluenzaA__AHZ40441

SEQ ID NO: 164732 - RNA, 1701 nt, Artificial Sequence; identical to SEQ ID NO: 162546
  derived and/or modified sequence opt4 from hemagglutinin__InfluenzaA__AHZ40453

SEQ ID NO: 164733 - RNA, 1701 nt, Artificial Sequence
  derived and/or modified sequence opt4 from hemagglutinin__InfluenzaA__AHZ40465
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacaugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagagauucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164734 - RNA, 1701 nt, Artificial Sequence; identical to SEQ ID NO: 162404
  derived and/or modified sequence opt4 from hemagglutinin__InfluenzaA__AHZ40477

SEQ ID NO: 164735 - RNA, 1701 nt, Artificial Sequence; identical to SEQ ID NO: 162580
  derived and/or modified sequence opt4 from hemagglutinin__InfluenzaA__AHZ40489

SEQ ID NO: 164736 - RNA, 1701 nt, Artificial Sequence; identical to SEQ ID NO: 162403
  derived and/or modified sequence opt4 from hemagglutinin__InfluenzaA__AHZ40500

SEQ ID NO: 164737 - RNA, 1701 nt, Artificial Sequence; identical to SEQ ID NO: 162403
  derived and/or modified sequence opt4 from hemagglutinin__InfluenzaA__AHZ40512

SEQ ID NO: 164738 - RNA, 1701 nt, Artificial Sequence
  derived and/or modified sequence opt4 from hemagglutinin__InfluenzaA__AHZ40524
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164739 - RNA, 1701 nt, Artificial Sequence; identical to SEQ ID NO: 164290
  derived and/or modified sequence opt4 from hemagglutinin__InfluenzaA__AHZ40536

SEQ ID NO: 164740 - RNA, 1701 nt, Artificial Sequence; identical to SEQ ID NO: 162403
  derived and/or modified sequence opt4 from hemagglutinin__InfluenzaA__AHZ40548

SEQ ID NO: 164741 - RNA, 1701 nt, Artificial Sequence; identical to SEQ ID NO: 162378
  derived and/or modified sequence opt4 from hemagglutinin__InfluenzaA__AHZ40572

SEQ ID NO: 164742 - RNA, 1701 nt, Artificial Sequence; identical to SEQ ID NO: 162378
  derived and/or modified sequence opt4 from hemagglutinin__InfluenzaA__AHZ40583

SEQ ID NO: 164743 - RNA, 1701 nt, Artificial Sequence
  derived and/or modified sequence opt4 from hemagglutinin__InfluenzaA__AHZ40595
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacgacggcaagcugugcaagcugagaggcguggccccccugcaccugggcaagugcaacaucgccggcuggauccugggcaaccccgagugcgagagccugagcaccgccagcagcuggagcuacaucguggagaccagcggcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaucagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccaugaagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 164744 - RNA, 1701 nt, Artificial Sequence
  derived and/or modified sequence opt4 from hemagglutinin__InfluenzaA__AHZ40606
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164745 - RNA, 1701 nt, Artificial Sequence; identical to SEQ ID NO: 162403
  derived and/or modified sequence opt4 from hemagglutinin__InfluenzaA__AHZ40618

SEQ ID NO: 164746 - RNA, 1701 nt, Artificial Sequence; identical to SEQ ID NO: 162442
  derived and/or modified sequence opt4 from hemagglutinin__InfluenzaA__AHZ40626

SEQ ID NO: 164747 - RNA, 1701 nt, Artificial Sequence; identical to SEQ ID NO: 162403
  derived and/or modified sequence opt4 from hemagglutinin__InfluenzaA__AHZ40638

SEQ ID NO: 164748 - RNA, 1701 nt, Artificial Sequence; identical to SEQ ID NO: 162378
  derived and/or modified sequence opt4 from hemagglutinin__InfluenzaA__AHZ40650

SEQ ID NO: 164749 - RNA, 1701 nt, Artificial Sequence
  derived and/or modified sequence opt4 from hemagglutinin__InfluenzaA__AHZ40662
augaagaccaucaucgcccugagcuacauccugugccugguguucgcccaggagcugcccggcaacgacgacagcaccgccacccugugccugggccaccacgccgugcccaacggcaccaucgugaagaccaucaccaacgacagaaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccauccccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164750 - RNA, 1701 nt, Artificial Sequence; identical to SEQ ID NO: 162423
  derived and/or modified sequence opt4 from hemagglutinin__InfluenzaA__AHZ40674

SEQ ID NO: 164751 - RNA, 1701 nt, Artificial Sequence; identical to SEQ ID NO: 162403
  derived and/or modified sequence opt4 from hemagglutinin__InfluenzaA__AHZ40686

SEQ ID NO: 164752 - RNA, 1701 nt, Artificial Sequence; identical to SEQ ID NO: 162388
  derived and/or modified sequence opt4 from hemagglutinin__InfluenzaA__AHZ40698

SEQ ID NO: 164753 - RNA, 1701 nt, Artificial Sequence; identical to SEQ ID NO: 162388
  derived and/or modified sequence opt4 from hemagglutinin__InfluenzaA__AHZ40710

SEQ ID NO: 164754 - RNA, 1701 nt, Artificial Sequence; identical to SEQ ID NO: 162514
  derived and/or modified sequence opt4 from hemagglutinin__InfluenzaA__AHZ40722

SEQ ID NO: 164755 - RNA, 1701 nt, Artificial Sequence; identical to SEQ ID NO: 162411
  derived and/or modified sequence opt4 from hemagglutinin__InfluenzaA__AHZ40734

SEQ ID NO: 164756 - RNA, 1701 nt, Artificial Sequence; identical to SEQ ID NO: 162514
  derived and/or modified sequence opt4 from hemagglutinin__InfluenzaA__AHZ40746

SEQ ID NO: 164757 - RNA, 1701 nt, Artificial Sequence; identical to SEQ ID NO: 164707
  derived and/or modified sequence opt4 from hemagglutinin__InfluenzaA__AHZ40758

SEQ ID NO: 164758 - RNA, 1701 nt, Artificial Sequence; identical to SEQ ID NO: 155187
  derived and/or modified sequence opt4 from hemagglutinin__InfluenzaA__AHZ40782

SEQ ID NO: 164759 - RNA, 1701 nt, Artificial Sequence; identical to SEQ ID NO: 155187
  derived and/or modified sequence opt4 from hemagglutinin__InfluenzaA__AHZ40793

SEQ ID NO: 164760 - RNA, 1701 nt, Artificial Sequence; identical to SEQ ID NO: 155187
  derived and/or modified sequence opt4 from hemagglutinin__InfluenzaA__AHZ40804

SEQ ID NO: 164761 - RNA, 1701 nt, Artificial Sequence
  derived and/or modified sequence opt4 from hemagglutinin__InfluenzaA__AHZ40815
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164762 - RNA, 1701 nt, Artificial Sequence
  derived and/or modified sequence opt4 from hemagglutinin__InfluenzaA__AHZ40826
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagcaucuaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164763 - RNA, 1701 nt, Artificial Sequence
  derived and/or modified sequence opt4 from hemagglutinin__InfluenzaA__AHZ40848
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaaggagggcaacagcuaccccaagcugagcaagagcuacaucaacgacaagggcaaggaggugcuggugcuguggggcauccaccaccccagcaccagcgccgagcagcagagccuguaccagaacgccgacgccuacguguucgugggcagcagcagauacagcaagaaguucaagcccgagaucgccgccagacccaaggugagaggccaggccggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164764 - RNA, 1701 nt, Artificial Sequence
  derived and/or modified sequence opt4 from hemagglutinin__InfluenzaA__AHZ40881
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgagcagcagagccuguaccagaacgccgacgccuacguguucgugggcagcagcagauacagcaagaaguucaagcccgagaucgccgccagacccaaggugagaggccaggccggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164765 - RNA, 1701 nt, Artificial Sequence; identical to SEQ ID NO: 164764
  derived and/or modified sequence opt4 from hemagglutinin__InfluenzaA__AHZ40892

SEQ ID NO: 164766 - RNA, 1701 nt, Artificial Sequence; identical to SEQ ID NO: 164763
  derived and/or modified sequence opt4 from hemagglutinin__InfluenzaA__AHZ40914

SEQ ID NO: 164767 - RNA, 1701 nt, Artificial Sequence; identical to SEQ ID NO: 164764
  derived and/or modified sequence opt4 from hemagglutinin__InfluenzaA__AHZ40925

SEQ ID NO: 164768 - RNA, 1701 nt, Artificial Sequence
  derived and/or modified sequence opt4 from hemagglutinin__InfluenzaA__AHZ40936
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgagcagcagagccuguaccagaacgccgacgccuacguguucgugggcagcagcagauacagcaagaaguucaagcccgagaucgccgccagacccaaggugagagaccaggccggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164769 - RNA, 1701 nt, Artificial Sequence; identical to SEQ ID NO: 164763
  derived and/or modified sequence opt4 from hemagglutinin__InfluenzaA__AHZ40947

SEQ ID NO: 164770 - RNA, 1701 nt, Artificial Sequence; identical to SEQ ID NO: 164764
  derived and/or modified sequence opt4 from hemagglutinin__InfluenzaA__AHZ40958

SEQ ID NO: 164771 - RNA, 1701 nt, Artificial Sequence; identical to SEQ ID NO: 164768
  derived and/or modified sequence opt4 from hemagglutinin__InfluenzaA__AHZ40969

SEQ ID NO: 164772 - RNA, 1701 nt, Artificial Sequence; identical to SEQ ID NO: 164768
  derived and/or modified sequence opt4 from hemagglutinin__InfluenzaA__AHZ40980

SEQ ID NO: 164773 - RNA, 1701 nt, Artificial Sequence; identical to SEQ ID NO: 164768
  derived and/or modified sequence opt4 from hemagglutinin__InfluenzaA__AHZ40991

SEQ ID NO: 164774 - RNA, 1701 nt, Artificial Sequence; identical to SEQ ID NO: 164768
  derived and/or modified sequence opt4 from hemagglutinin__InfluenzaA__AHZ41002

SEQ ID NO: 164775 - RNA, 1701 nt, Artificial Sequence; identical to SEQ ID NO: 164768
  derived and/or modified sequence opt4 from hemagglutinin__InfluenzaA__AHZ41013

SEQ ID NO: 164776 - RNA, 1701 nt, Artificial Sequence; identical to SEQ ID NO: 164764
  derived and/or modified sequence opt4 from hemagglutinin__InfluenzaA__AHZ41024

SEQ ID NO: 164777 - RNA, 1701 nt, Artificial Sequence; identical to SEQ ID NO: 164764
  derived and/or modified sequence opt4 from hemagglutinin__InfluenzaA__AHZ41035

SEQ ID NO: 164778 - RNA, 1701 nt, Artificial Sequence; identical to SEQ ID NO: 164764
  derived and/or modified sequence opt4 from hemagglutinin__InfluenzaA__AHZ41046

SEQ ID NO: 164779 - RNA, 1701 nt, Artificial Sequence; identical to SEQ ID NO: 164764
  derived and/or modified sequence opt4 from hemagglutinin__InfluenzaA__AHZ41057

SEQ ID NO: 164780 - RNA, 1701 nt, Artificial Sequence; identical to SEQ ID NO: 164764
  derived and/or modified sequence opt4 from hemagglutinin__InfluenzaA__AHZ41068

SEQ ID NO: 164781 - RNA, 1701 nt, Artificial Sequence; identical to SEQ ID NO: 164768
  derived and/or modified sequence opt4 from hemagglutinin__InfluenzaA__AHZ41079

SEQ ID NO: 164782 - RNA, 1701 nt, Artificial Sequence; identical to SEQ ID NO: 164764
  derived and/or modified sequence opt4 from hemagglutinin__InfluenzaA__AHZ41090

SEQ ID NO: 164783 - RNA, 1701 nt, Artificial Sequence; identical to SEQ ID NO: 164768
  derived and/or modified sequence opt4 from hemagglutinin__InfluenzaA__AHZ41101

SEQ ID NO: 164784 - RNA, 1701 nt, Artificial Sequence; identical to SEQ ID NO: 164764
  derived and/or modified sequence opt4 from hemagglutinin__InfluenzaA__AHZ41112

SEQ ID NO: 164785 - RNA, 1701 nt, Artificial Sequence; identical to SEQ ID NO: 164764
  derived and/or modified sequence opt4 from hemagglutinin__InfluenzaA__AHZ41123

SEQ ID NO: 164786 - RNA, 1701 nt, Artificial Sequence; identical to SEQ ID NO: 164764
  derived and/or modified sequence opt4 from hemagglutinin__InfluenzaA__AHZ41134

SEQ ID NO: 164787 - RNA, 1701 nt, Artificial Sequence; identical to SEQ ID NO: 164764
  derived and/or modified sequence opt4 from hemagglutinin__InfluenzaA__AHZ41145

SEQ ID NO: 164788 - RNA, 1701 nt, Artificial Sequence; identical to SEQ ID NO: 164764
  derived and/or modified sequence opt4 from hemagglutinin__InfluenzaA__AHZ41156

SEQ ID NO: 164789 - RNA, 1701 nt, Artificial Sequence; identical to SEQ ID NO: 164764
  derived and/or modified sequence opt4 from hemagglutinin__InfluenzaA__AHZ41167

SEQ ID NO: 164790 - RNA, 1701 nt, Artificial Sequence; identical to SEQ ID NO: 164764
  derived and/or modified sequence opt4 from hemagglutinin__InfluenzaA__AHZ41178

SEQ ID NO: 164791 - RNA, 1701 nt, Artificial Sequence; identical to SEQ ID NO: 164764
  derived and/or modified sequence opt4 from hemagglutinin__InfluenzaA__AHZ41189

SEQ ID NO: 164792 - RNA, 1701 nt, Artificial Sequence; identical to SEQ ID NO: 164763
  derived and/or modified sequence opt4 from hemagglutinin__InfluenzaA__AHZ41246

SEQ ID NO: 164793 - RNA, 1701 nt, Artificial Sequence; identical to SEQ ID NO: 164768
  derived and/or modified sequence opt4 from hemagglutinin__InfluenzaA__AHZ41263

SEQ ID NO: 164794 - RNA, 1701 nt, Artificial Sequence; identical to SEQ ID NO: 164764
  derived and/or modified sequence opt4 from hemagglutinin__InfluenzaA__AHZ41281

SEQ ID NO: 164795 - RNA, 1701 nt, Artificial Sequence; identical to SEQ ID NO: 164764
  derived and/or modified sequence opt4 from hemagglutinin__InfluenzaA__AHZ41292

SEQ ID NO: 164796 - RNA, 1701 nt, Artificial Sequence; identical to SEQ ID NO: 164763
  derived and/or modified sequence opt4 from hemagglutinin__InfluenzaA__AHZ41303

SEQ ID NO: 164797 - RNA, 1701 nt, Artificial Sequence; identical to SEQ ID NO: 164763
  derived and/or modified sequence opt4 from hemagglutinin__InfluenzaA__AHZ41314

SEQ ID NO: 164798 - RNA, 1701 nt, Artificial Sequence; identical to SEQ ID NO: 164763
  derived and/or modified sequence opt4 from hemagglutinin__InfluenzaA__AHZ41325

SEQ ID NO: 164799 - RNA, 1701 nt, Artificial Sequence; identical to SEQ ID NO: 164763
  derived and/or modified sequence opt4 from hemagglutinin__InfluenzaA__AHZ41336

SEQ ID NO: 164800 - RNA, 1701 nt, Artificial Sequence; identical to SEQ ID NO: 164763
  derived and/or modified sequence opt4 from hemagglutinin__InfluenzaA__AHZ41347

SEQ ID NO: 164801 - RNA, 1701 nt, Artificial Sequence; identical to SEQ ID NO: 164764
  derived and/or modified sequence opt4 from hemagglutinin__InfluenzaA__AHZ41358

SEQ ID NO: 164802 - RNA, 1701 nt, Artificial Sequence; identical to SEQ ID NO: 164764
  derived and/or modified sequence opt4 from hemagglutinin__InfluenzaA__AHZ41366

SEQ ID NO: 164803 - RNA, 1701 nt, Artificial Sequence; identical to SEQ ID NO: 164768
  derived and/or modified sequence opt4 from hemagglutinin__InfluenzaA__AHZ41377

SEQ ID NO: 164804 - RNA, 1701 nt, Artificial Sequence; identical to SEQ ID NO: 164764
  derived and/or modified sequence opt4 from hemagglutinin__InfluenzaA__AHZ41388

SEQ ID NO: 164805 - RNA, 1701 nt, Artificial Sequence; identical to SEQ ID NO: 164768
  derived and/or modified sequence opt4 from hemagglutinin__InfluenzaA__AHZ41410

SEQ ID NO: 164806 - RNA, 1701 nt, Artificial Sequence; identical to SEQ ID NO: 164764
  derived and/or modified sequence opt4 from hemagglutinin__InfluenzaA__AHZ41432

SEQ ID NO: 164807 - RNA, 1701 nt, Artificial Sequence
  derived and/or modified sequence opt4 from hemagglutinin__InfluenzaA__AHZ41441
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaaggagggcaacagcuaccccaagcugagcaagagcuacaucaacgacaagggcaaggaggugcuggugcuguggggcauccaccaccccagcaccagcgccgagcagcagagccuguaccagaacgccgacgccuacguguucgugggcagcagcagauacagcaagaaguucaagcccgagaucgccgccagacccaaggugagagaccaggccggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164808 - RNA, 1701 nt, Artificial Sequence; identical to SEQ ID NO: 164763
  derived and/or modified sequence opt4 from hemagglutinin__InfluenzaA__AHZ41452

SEQ ID NO: 164809 - RNA, 1701 nt, Artificial Sequence
  derived and/or modified sequence opt4 from hemagglutinin__InfluenzaA__AHZ41463
augaaggccauccugguggugcugcuguacaccuucgccaccgccaacgccgacacccugugcaucggcuaccacgccaacaacagcaccgacaccguguacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgagcagcagagccuguaccagaacgccgacgccuacguguucgugggcagcagcagauacagcaagaaguucaagcccgagaucgccgccagacccaaggugagaggccaggccggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164810 - RNA, 1701 nt, Artificial Sequence; identical to SEQ ID NO: 164763
  derived and/or modified sequence opt4 from hemagglutinin__InfluenzaA__AHZ41473

SEQ ID NO: 164811 - RNA, 1701 nt, Artificial Sequence; identical to SEQ ID NO: 164763
  derived and/or modified sequence opt4 from hemagglutinin__InfluenzaA__AHZ41484

SEQ ID NO: 164812 - RNA, 1701 nt, Artificial Sequence; identical to SEQ ID NO: 164768
  derived and/or modified sequence opt4 from hemagglutinin__InfluenzaA__AHZ41495

SEQ ID NO: 164813 - RNA, 1701 nt, Artificial Sequence; identical to SEQ ID NO: 164763
  derived and/or modified sequence opt4 from hemagglutinin__InfluenzaA__AHZ41506

SEQ ID NO: 164814 - RNA, 1701 nt, Artificial Sequence
  derived and/or modified sequence opt4 from hemagglutinin__InfluenzaA__AHZ41517
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcgagagcuacaucaacgacaagggcaaggaggugcuggugcuguggggcauccaccaccccagcaccagcgccgagcagcagagccuguaccagaacgccgacgccuacguguucgugggcagcagcagauacagcaagaaguucaagcccgagaucgccgccagacccaaggugagaggccaggccggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164815 - RNA, 1701 nt, Artificial Sequence
  derived and/or modified sequence opt4 from hemagglutinin__InfluenzaA__AHZ41528
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcgagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccgccagacccaaggugagaggccaggccggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164816 - RNA, 1701 nt, Artificial Sequence; identical to SEQ ID NO: 164768
  derived and/or modified sequence opt4 from hemagglutinin__InfluenzaA__AHZ41539

SEQ ID NO: 164817 - RNA, 1701 nt, Artificial Sequence; identical to SEQ ID NO: 164763
  derived and/or modified sequence opt4 from hemagglutinin__InfluenzaA__AHZ41550

SEQ ID NO: 164818 - RNA, 1701 nt, Artificial Sequence; identical to SEQ ID NO: 164764
  derived and/or modified sequence opt4 from hemagglutinin__InfluenzaA__AHZ41561

SEQ ID NO: 164819 - RNA, 1701 nt, Artificial Sequence
  derived and/or modified sequence opt4 from hemagglutinin__InfluenzaA__AHZ41572
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgagcagcagagccuguaccagaacgccgacgccuacguguucgugggcagcagcagauacagcaagaaguucaagcccgagaucgccgccagacccaaggugagaggccaggccggcagaaugaacuacuacuggacccugguggagcccggcgacgagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164820 - RNA, 1701 nt, Artificial Sequence; identical to SEQ ID NO: 164768
  derived and/or modified sequence opt4 from hemagglutinin__InfluenzaA__AHZ41583

SEQ ID NO: 164821 - RNA, 1701 nt, Artificial Sequence; identical to SEQ ID NO: 164763
  derived and/or modified sequence opt4 from hemagglutinin__InfluenzaA__AHZ41594

SEQ ID NO: 164822 - RNA, 1701 nt, Artificial Sequence
  derived and/or modified sequence opt4 from hemagglutinin__InfluenzaA__AHZ41605
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaacaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgagcagcagagccuguaccagaacgccgacgccuacguguucgugggcagcagcagauacagcaagaaguucaagcccgagaucgccgccagacccaaggugaugggccaggccggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164823 - RNA, 1701 nt, Artificial Sequence; identical to SEQ ID NO: 164763
  derived and/or modified sequence opt4 from hemagglutinin__InfluenzaA__AHZ41616

SEQ ID NO: 164824 - RNA, 1701 nt, Artificial Sequence; identical to SEQ ID NO: 164768
  derived and/or modified sequence opt4 from hemagglutinin__InfluenzaA__AHZ41627

SEQ ID NO: 164825 - RNA, 1701 nt, Artificial Sequence; identical to SEQ ID NO: 164768
  derived and/or modified sequence opt4 from hemagglutinin__InfluenzaA__AHZ41638

SEQ ID NO: 164826 - RNA, 1701 nt, Artificial Sequence; identical to SEQ ID NO: 164764
  derived and/or modified sequence opt4 from hemagglutinin__InfluenzaA__AHZ41649

SEQ ID NO: 164827 - RNA, 1701 nt, Artificial Sequence; identical to SEQ ID NO: 164764
  derived and/or modified sequence opt4 from hemagglutinin__InfluenzaA__AHZ41660

SEQ ID NO: 164828 - RNA, 1701 nt, Artificial Sequence; identical to SEQ ID NO: 164768
  derived and/or modified sequence opt4 from hemagglutinin__InfluenzaA__AHZ41671

SEQ ID NO: 164829 - RNA, 1701 nt, Artificial Sequence; identical to SEQ ID NO: 164768
  derived and/or modified sequence opt4 from hemagglutinin__InfluenzaA__AHZ41682

SEQ ID NO: 164830 - RNA, 1701 nt, Artificial Sequence; identical to SEQ ID NO: 164768
  derived and/or modified sequence opt4 from hemagglutinin__InfluenzaA__AHZ41693

SEQ ID NO: 164831 - RNA, 1701 nt, Artificial Sequence; identical to SEQ ID NO: 164768
  derived and/or modified sequence opt4 from hemagglutinin__InfluenzaA__AHZ41704

SEQ ID NO: 164832 - RNA, 1701 nt, Artificial Sequence; identical to SEQ ID NO: 164768
  derived and/or modified sequence opt4 from hemagglutinin__InfluenzaA__AHZ41715

SEQ ID NO: 164833 - RNA, 1701 nt, Artificial Sequence; identical to SEQ ID NO: 164768
  derived and/or modified sequence opt4 from hemagglutinin__InfluenzaA__AHZ41726

SEQ ID NO: 164834 - RNA, 1701 nt, Artificial Sequence; identical to SEQ ID NO: 164768
  derived and/or modified sequence opt4 from hemagglutinin__InfluenzaA__AHZ41737

SEQ ID NO: 164835 - RNA, 1701 nt, Artificial Sequence; identical to SEQ ID NO: 164768
  derived and/or modified sequence opt4 from hemagglutinin__InfluenzaA__AHZ41748

SEQ ID NO: 164836 - RNA, 1701 nt, Artificial Sequence; identical to SEQ ID NO: 164768
  derived and/or modified sequence opt4 from hemagglutinin__InfluenzaA__AHZ41759

SEQ ID NO: 164837 - RNA, 1701 nt, Artificial Sequence; identical to SEQ ID NO: 162595
  derived and/or modified sequence opt4 from hemagglutinin__InfluenzaA__AHZ42561

SEQ ID NO: 164838 - RNA, 1701 nt, Artificial Sequence
  derived and/or modified sequence opt4 from hemagglutinin__InfluenzaA__AHZ42572
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagauggacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164839 - RNA, 1701 nt, Artificial Sequence; identical to SEQ ID NO: 164306
  derived and/or modified sequence opt4 from hemagglutinin__InfluenzaA__AHZ42584

SEQ ID NO: 164840 - RNA, 1701 nt, Artificial Sequence; identical to SEQ ID NO: 162403
  derived and/or modified sequence opt4 from hemagglutinin__InfluenzaA__AHZ42596

SEQ ID NO: 164841 - RNA, 1701 nt, Artificial Sequence; identical to SEQ ID NO: 162580
  derived and/or modified sequence opt4 from hemagglutinin__InfluenzaA__AHZ42608

SEQ ID NO: 164842 - RNA, 1701 nt, Artificial Sequence; identical to SEQ ID NO: 162403
  derived and/or modified sequence opt4 from hemagglutinin__InfluenzaA__AHZ42619

SEQ ID NO: 164843 - RNA, 1701 nt, Artificial Sequence
  derived and/or modified sequence opt4 from hemagglutinin__InfluenzaA__AHZ42631
augaagaccaucaucgcccugagcuacauccugugccugguguucgcccagaagcugcccggcaacuacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164844 - RNA, 1701 nt, Artificial Sequence
  derived and/or modified sequence opt4 from hemagglutinin__InfluenzaA__AHZ42643
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcggcagcgacaacggcaccugcuaccccggcgacuucaucgacuacgaggagcugagagagcagcugagcagcgugagcagcuucgagagauucgagaucuuccccaaggccagcagcuggcccaaccacgacagcaacaagggcgugaccgccgccugcccccacgccggcgccaagggcuucuacaagaaccugaucuggcuggugaagaagggcaacagcuaccccaagcugagcaucagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 164845 - RNA, 1701 nt, Artificial Sequence; identical to SEQ ID NO: 162403
  derived and/or modified sequence opt4 from hemagglutinin__InfluenzaA__AHZ42654

SEQ ID NO: 164846 - RNA, 1701 nt, Artificial Sequence; identical to SEQ ID NO: 162378
  derived and/or modified sequence opt4 from hemagglutinin__InfluenzaA__AHZ42666

SEQ ID NO: 164847 - RNA, 1701 nt, Artificial Sequence; identical to SEQ ID NO: 162378
  derived and/or modified sequence opt4 from hemagglutinin__InfluenzaA__AHZ42678

SEQ ID NO: 164848 - RNA, 1701 nt, Artificial Sequence
  derived and/or modified sequence opt4 from hemagglutinin__InfluenzaA__AHZ42690
augaaggccauccugguggugcugcuguacaccuacgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164849 - RNA, 1701 nt, Artificial Sequence; identical to SEQ ID NO: 162403
  derived and/or modified sequence opt4 from hemagglutinin__InfluenzaA__AHZ42701

SEQ ID NO: 164850 - RNA, 1701 nt, Artificial Sequence; identical to SEQ ID NO: 162378
  derived and/or modified sequence opt4 from hemagglutinin__InfluenzaA__AHZ42713

SEQ ID NO: 164851 - RNA, 1701 nt, Artificial Sequence
  derived and/or modified sequence opt4 from hemagglutinin__InfluenzaA__AHZ42725
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164852 - RNA, 1701 nt, Artificial Sequence
  derived and/or modified sequence opt4 from hemagglutinin__InfluenzaA__AHZ42737
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccgagagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164853 - RNA, 1701 nt, Artificial Sequence; identical to SEQ ID NO: 162403
  derived and/or modified sequence opt4 from hemagglutinin__InfluenzaA__AHZ42748

SEQ ID NO: 164854 - RNA, 1701 nt, Artificial Sequence; identical to SEQ ID NO: 162423
  derived and/or modified sequence opt4 from hemagglutinin__InfluenzaA__AHZ42760

SEQ ID NO: 164855 - RNA, 1701 nt, Artificial Sequence
  derived and/or modified sequence opt4 from hemagglutinin__InfluenzaA__AHZ42772
augaagaccaucaucgcccugagcuacauccugugccugguguucgcccaggagcugcccggcaacgacgacagcaccgccacccugugccugggccaccacgccgugcccaacggcaccaucgugaagaccaucaccaacgacagaaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaaggagguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164856 - RNA, 1701 nt, Artificial Sequence; identical to SEQ ID NO: 162403
  derived and/or modified sequence opt4 from hemagglutinin__InfluenzaA__AHZ42784

SEQ ID NO: 164857 - RNA, 1701 nt, Artificial Sequence; identical to SEQ ID NO: 162378
  derived and/or modified sequence opt4 from hemagglutinin__InfluenzaA__AHZ42796

SEQ ID NO: 164858 - RNA, 1701 nt, Artificial Sequence; identical to SEQ ID NO: 162378
  derived and/or modified sequence opt4 from hemagglutinin__InfluenzaA__AHZ42808

SEQ ID NO: 164859 - RNA, 1701 nt, Artificial Sequence; identical to SEQ ID NO: 164852
  derived and/or modified sequence opt4 from hemagglutinin__InfluenzaA__AHZ42820

SEQ ID NO: 164860 - RNA, 1701 nt, Artificial Sequence; identical to SEQ ID NO: 162987
  derived and/or modified sequence opt4 from hemagglutinin__InfluenzaA__AHZ42831

SEQ ID NO: 164861 - RNA, 1701 nt, Artificial Sequence
  derived and/or modified sequence opt4 from hemagglutinin__InfluenzaA__AHZ42843
augaagaccaucaucgcccugagcuacauccugugccugguguucgcccagaagcugcccggcaacgacaacagcaccgccacccugugccugggccaccacgccgugcccaacggcaccauggugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164862 - RNA, 1701 nt, Artificial Sequence
  derived and/or modified sequence opt4 from hemagglutinin__InfluenzaA__AHZ42855
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacaugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164863 - RNA, 1701 nt, Artificial Sequence
  derived and/or modified sequence opt4 from hemagglutinin__InfluenzaA__AHZ42867
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcgaguacaaggacuggauccuguggaucagcuucgccaucagcugcuuccugcugugcguggcccugcugggcuucaucaugugggccugccagaagggcaacaucagaugcaacaucugcaucuga

SEQ ID NO: 164864 - RNA, 1701 nt, Artificial Sequence; identical to SEQ ID NO: 162378
  derived and/or modified sequence opt4 from hemagglutinin__InfluenzaA__AHZ42879

SEQ ID NO: 164865 - RNA, 1701 nt, Artificial Sequence
  derived and/or modified sequence opt4 from hemagglutinin__InfluenzaA__AHZ42891
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcagcugcuaccccuacgacgugcccgacuacgccagccugagaagccugguggccagcagcggcacccuggaguucaacaacgagagcuucaacugggccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164866 - RNA, 1701 nt, Artificial Sequence
  derived and/or modified sequence opt4 from hemagglutinin__InfluenzaA__AHZ42903
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164867 - RNA, 1701 nt, Artificial Sequence; identical to SEQ ID NO: 162355
  derived and/or modified sequence opt4 from hemagglutinin__InfluenzaA__AHZ42915

SEQ ID NO: 164868 - RNA, 1683 nt, Artificial Sequence; identical to SEQ ID NO: 162508
  derived and/or modified sequence opt4 from hemagglutinin__InfluenzaA__AHZ59747

SEQ ID NO: 164869 - RNA, 1683 nt, Artificial Sequence
  derived and/or modified sequence opt4 from hemagglutinin__InfluenzaA__AHZ59759
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgccaccagcgccugcagaagaagcggcagcagcuucuacgccgagaugaaguggcugcugagcaacaccgacaacgccgccuucccccagaugaccaagagcuacaagaacaccagaaagagccccgcccugaucguguggggcauccaccacagcgugagcaccgccgagcagaccaagcuguacggcagcggcaacaagcuggugaccgugggcagcagcaacuaccagcagagcuucgugcccagccccggcgccagaccccaggugaacggccugagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagagccgugggcaagugccccagauacgugaagcagagaagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaacgagguggagaagcagaucggcaacgugaucaacuggaccagagacagcaucaccgagguguggagcuacaacgccgagcugcugguggccauggagaaccagcacaccaucgaccuggccgacagcgagauggacaagcuguacgagagagugaagagacagcugagagagaacgccgaggaggacggcaccggcugcuucgagaucuuccacaagugcgacgacgacugcauggccagcaucagaaacaacaccuacgaccacagcaagagcagagaggaggccaugcagaacagaauccagaucgaccccgugaagcugagcagcggcuacaaggacgugauccugugguucagcuucggcgccagcugcuucauccugcuggccaucgugaugggccugguguucaucugcgugaagaacggcaacaugagaugcaccaucugcaucuga

SEQ ID NO: 164870 - RNA, 1683 nt, Artificial Sequence
  derived and/or modified sequence opt4 from hemagglutinin__InfluenzaA__AHZ59771
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgccaccagcgccugcagaagaagcggcagcagcuucuacgccgagaugaaguggcugcugagcaacaccgacaacgccgccuucccccagaugaccaagagcuacaagaacaccagaaagagccccgcccugaucguguggggcauccaccacagcgugagcaccgccgagcagaccaagcuguacggcagcggcaacaagcuggugaccgugggcagcagcaacuaccagcagagcuucgugcccagccccggcgccagaccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagagccgugggcaagugccccagauacgugaagcagagaagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaacgagguggagaagcagaucggcaacgugaucaacuggaccagagacagcaucaccgagguguggagcuacaacgccgagcugcugguggccauggagaaccagcacaccaucgaccuggccgacagcgagauggacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgugaugggccugguguucaucugcgugaagaacggcaacaugagaugcaccaucugcaucuga

SEQ ID NO: 164871 - RNA, 1683 nt, Artificial Sequence
  derived and/or modified sequence opt4 from hemagglutinin__InfluenzaA__AHZ59795
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcaccaccagcgccugcagaagaagcggcagcagcuucuacgccgagaugaaguggcugcugagcaacaccgacaacgccgccuucccccagaugaccaagagcuacaagaacaccagaaagagccccgcccugaucguguggggcauccaccacagcgugagcaccgccgagcagaccaagcuguacggcagcggcaacaagcuggugaccgugggcagcagcaacuaccagcagagcuucgugcccagccccggcgccagaccccaggugaacggccugagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagagccgugggcaagugccccagauacgugaagcagagaagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaacgagguggagaagcagaucggcaacgugaucaacuggaccagagacagcaucaccgagguguggagcuacaacgccgagcugcugguggccauggagaaccagcacaccaucgaccuggccgacagcgagauggacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgugaugggccugguguucaucugcgugaagaacggcaacaugagaugcaccaucugcaucuga

SEQ ID NO: 164872 - RNA, 1683 nt, Artificial Sequence; identical to SEQ ID NO: 164871
  derived and/or modified sequence opt4 from hemagglutinin__InfluenzaA__AHZ59807

SEQ ID NO: 164873 - RNA, 1683 nt, Artificial Sequence; identical to SEQ ID NO: 164871
  derived and/or modified sequence opt4 from hemagglutinin__InfluenzaA__AHZ59819

SEQ ID NO: 164874 - RNA, 1683 nt, Artificial Sequence; identical to SEQ ID NO: 162508
  derived and/or modified sequence opt4 from hemagglutinin__InfluenzaA__AHZ59831

SEQ ID NO: 164875 - RNA, 1683 nt, Artificial Sequence; identical to SEQ ID NO: 162508
  derived and/or modified sequence opt4 from hemagglutinin__InfluenzaA__AHZ59843

SEQ ID NO: 164876 - RNA, 1683 nt, Artificial Sequence; identical to SEQ ID NO: 162508
  derived and/or modified sequence opt4 from hemagglutinin__InfluenzaA__AHZ59855

SEQ ID NO: 164877 - RNA, 1683 nt, Artificial Sequence; identical to SEQ ID NO: 164870
  derived and/or modified sequence opt4 from hemagglutinin__InfluenzaA__AHZ59867

SEQ ID NO: 164878 - RNA, 1683 nt, Artificial Sequence; identical to SEQ ID NO: 162508
  derived and/or modified sequence opt4 from hemagglutinin__InfluenzaA__AHZ59879

SEQ ID NO: 164879 - RNA, 1683 nt, Artificial Sequence; identical to SEQ ID NO: 164870
  derived and/or modified sequence opt4 from hemagglutinin__InfluenzaA__AHZ59915

SEQ ID NO: 164880 - RNA, 1683 nt, Artificial Sequence; identical to SEQ ID NO: 162508
  derived and/or modified sequence opt4 from hemagglutinin__InfluenzaA__AHZ59927

SEQ ID NO: 164881 - RNA, 1683 nt, Artificial Sequence; identical to SEQ ID NO: 164870
  derived and/or modified sequence opt4 from hemagglutinin__InfluenzaA__AHZ59939

SEQ ID NO: 164882 - RNA, 1683 nt, Artificial Sequence; identical to SEQ ID NO: 162508
  derived and/or modified sequence opt4 from hemagglutinin__InfluenzaA__AHZ59951

SEQ ID NO: 164883 - RNA, 1683 nt, Artificial Sequence; identical to SEQ ID NO: 162508
  derived and/or modified sequence opt4 from hemagglutinin__InfluenzaA__AHZ59963

SEQ ID NO: 164884 - RNA, 1683 nt, Artificial Sequence; identical to SEQ ID NO: 162508
  derived and/or modified sequence opt4 from hemagglutinin__InfluenzaA__AHZ59988

SEQ ID NO: 164885 - RNA, 1683 nt, Artificial Sequence; identical to SEQ ID NO: 162508
  derived and/or modified sequence opt4 from hemagglutinin__InfluenzaA__AHZ60000

SEQ ID NO: 164886 - RNA, 1683 nt, Artificial Sequence; identical to SEQ ID NO: 162508
  derived and/or modified sequence opt4 from hemagglutinin__InfluenzaA__AHZ60012

SEQ ID NO: 164887 - RNA, 1683 nt, Artificial Sequence; identical to SEQ ID NO: 162508
  derived and/or modified sequence opt4 from hemagglutinin__InfluenzaA__AHZ60024

SEQ ID NO: 164888 - RNA, 1683 nt, Artificial Sequence; identical to SEQ ID NO: 164871
  derived and/or modified sequence opt4 from hemagglutinin__InfluenzaA__AHZ60036

SEQ ID NO: 164889 - RNA, 1683 nt, Artificial Sequence; identical to SEQ ID NO: 164871
  derived and/or modified sequence opt4 from hemagglutinin__InfluenzaA__AHZ60048

SEQ ID NO: 164890 - RNA, 1683 nt, Artificial Sequence; identical to SEQ ID NO: 164871
  derived and/or modified sequence opt4 from hemagglutinin__InfluenzaA__AHZ60060

SEQ ID NO: 164891 - RNA, 1683 nt, Artificial Sequence; identical to SEQ ID NO: 164871
  derived and/or modified sequence opt4 from hemagglutinin__InfluenzaA__AHZ60072

SEQ ID NO: 164892 - RNA, 1683 nt, Artificial Sequence; identical to SEQ ID NO: 164871
  derived and/or modified sequence opt4 from hemagglutinin__InfluenzaA__AHZ60084

SEQ ID NO: 164893 - RNA, 1683 nt, Artificial Sequence
  derived and/or modified sequence opt4 from hemagglutinin__InfluenzaA__AHZ60096
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgccaccagcgccugcagaagaagcggcagcagcuucuacgccgagaugaaguggcugcugagcaacaccgacgacgccgccuucccccagaugaccaagagcuacaagaacaccagaaagagccccgcccugaucguguggggcauccaccacagcgugagcaccgccgagcagaccaagcuguacggcagcggcaacaagcuggugaccgugggcagcagcaacuaccagcagagcuucgugcccagccccggcgccagaccccaggugaacggccugagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagagccgugggcaagugccccagauacgugaagcagagaagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaacgagguggagaagcagaucggcaacgugaucaacuggaccagagacagcaucaccgagguguggagcuacaacgccgagcugcugguggccauggagaaccagcacaccaucgaccuggccgacagcgagauggacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgugaugggccugguguucaucugcgugaagaacggcaacaugagaugcaccaucugcaucuga

SEQ ID NO: 164894 - RNA, 1701 nt, Artificial Sequence
  derived and/or modified sequence opt4 from hemagglutinin__InfluenzaA__AIC64889
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaaggagaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164895 - RNA, 1701 nt, Artificial Sequence; identical to SEQ ID NO: 162560
  derived and/or modified sequence opt4 from hemagglutinin__InfluenzaA__AIC73738

SEQ ID NO: 164896 - RNA, 1701 nt, Artificial Sequence
  derived and/or modified sequence opt4 from hemagglutinin__InfluenzaA__AIC73739
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagacacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164897 - RNA, 1701 nt, Artificial Sequence
  derived and/or modified sequence opt4 from hemagglutinin__InfluenzaA__AIC73740
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccacccccccaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcuggacagagagaagaucgacggcgugagacuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164898 - RNA, 1701 nt, Artificial Sequence
  derived and/or modified sequence opt4 from hemagglutinin__InfluenzaA__AIC73741
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccacugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacagaugcgacaacgccugcaucggcagcaucagaaacggcaccuacgaccacaacguguacagagacgaggcccugaacaacagauuccagaucagaggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164899 - RNA, 1701 nt, Artificial Sequence
  derived and/or modified sequence opt4 from hemagglutinin__InfluenzaA__AIC73742
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagacagagcuacaucaacgacaagggcaaggaggugcuggugcuguggggcauccaccaccccagcaccaccaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacagaaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164900 - RNA, 1701 nt, Artificial Sequence; identical to SEQ ID NO: 164899
  derived and/or modified sequence opt4 from hemagglutinin__InfluenzaA__AIC73743

SEQ ID NO: 164901 - RNA, 1701 nt, Artificial Sequence
  derived and/or modified sequence opt4 from hemagglutinin__InfluenzaA__AIC73744
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaaccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgcccacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164902 - RNA, 1701 nt, Artificial Sequence
  derived and/or modified sequence opt4 from hemagglutinin__InfluenzaA__AIC73745
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacugggcccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164903 - RNA, 1701 nt, Artificial Sequence
  derived and/or modified sequence opt4 from hemagglutinin__InfluenzaA__AIC73746
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcgugaccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164904 - RNA, 1701 nt, Artificial Sequence
  derived and/or modified sequence opt4 from hemagglutinin__InfluenzaA__AIC73747
augaaggccauccugguggugcugcuguacacccuggccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacaccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164905 - RNA, 1701 nt, Artificial Sequence; identical to SEQ ID NO: 162560
  derived and/or modified sequence opt4 from hemagglutinin__InfluenzaA__AIC73748

SEQ ID NO: 164906 - RNA, 1701 nt, Artificial Sequence
  derived and/or modified sequence opt4 from hemagglutinin__InfluenzaA__AIC73749
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagagaugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccacagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaagagcgagugcaucacccccaacggcagcaucaccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164907 - RNA, 1701 nt, Artificial Sequence; identical to SEQ ID NO: 162560
  derived and/or modified sequence opt4 from hemagglutinin__InfluenzaA__AIC73750

SEQ ID NO: 164908 - RNA, 1701 nt, Artificial Sequence
  derived and/or modified sequence opt4 from hemagglutinin__InfluenzaA__AIC73754
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcagaaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164909 - RNA, 1701 nt, Artificial Sequence; identical to SEQ ID NO: 162560
  derived and/or modified sequence opt4 from hemagglutinin__InfluenzaA__AIC73755

SEQ ID NO: 164910 - RNA, 1701 nt, Artificial Sequence; identical to SEQ ID NO: 162560
  derived and/or modified sequence opt4 from hemagglutinin__InfluenzaA__AIC73756

SEQ ID NO: 164911 - RNA, 1701 nt, Artificial Sequence; identical to SEQ ID NO: 162560
  derived and/or modified sequence opt4 from hemagglutinin__InfluenzaA__AIC73757

SEQ ID NO: 164912 - RNA, 1701 nt, Artificial Sequence
  derived and/or modified sequence opt4 from hemagglutinin__InfluenzaA__AIC73758
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcaucgccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164913 - RNA, 1701 nt, Artificial Sequence
  derived and/or modified sequence opt4 from hemagglutinin__InfluenzaA__AIC73760
augaaggccauccugaucgugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164914 - RNA, 1701 nt, Artificial Sequence; identical to SEQ ID NO: 164913
  derived and/or modified sequence opt4 from hemagglutinin__InfluenzaA__AIC73761

SEQ ID NO: 164915 - RNA, 1701 nt, Artificial Sequence; identical to SEQ ID NO: 164440
  derived and/or modified sequence opt4 from hemagglutinin__InfluenzaA__AIC73762

SEQ ID NO: 164916 - RNA, 1701 nt, Artificial Sequence
  derived and/or modified sequence opt4 from hemagglutinin__InfluenzaA__AIC73763
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagaucagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164917 - RNA, 1701 nt, Artificial Sequence; identical to SEQ ID NO: 162560
  derived and/or modified sequence opt4 from hemagglutinin__InfluenzaA__AIC73765

SEQ ID NO: 164918 - RNA, 1701 nt, Artificial Sequence; identical to SEQ ID NO: 162560
  derived and/or modified sequence opt4 from hemagglutinin__InfluenzaA__AIC73766

SEQ ID NO: 164919 - RNA, 1701 nt, Artificial Sequence
  derived and/or modified sequence opt4 from hemagglutinin__InfluenzaA__AIC73767
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcugaucaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaagaucagaaaccagcugaagaacaacgccaaggagaucggcaacggcugcuucgaguucuaccacaagugcgacaacaugugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164920 - RNA, 1701 nt, Artificial Sequence; identical to SEQ ID NO: 162560
  derived and/or modified sequence opt4 from hemagglutinin__InfluenzaA__AIC73768

SEQ ID NO: 164921 - RNA, 1701 nt, Artificial Sequence; identical to SEQ ID NO: 162560
  derived and/or modified sequence opt4 from hemagglutinin__InfluenzaA__AIC73769

SEQ ID NO: 164922 - RNA, 1701 nt, Artificial Sequence; identical to SEQ ID NO: 162560
  derived and/or modified sequence opt4 from hemagglutinin__InfluenzaA__AIC73770

SEQ ID NO: 164923 - RNA, 1701 nt, Artificial Sequence; identical to SEQ ID NO: 162560
  derived and/or modified sequence opt4 from hemagglutinin__InfluenzaA__AIC73771

SEQ ID NO: 164924 - RNA, 1701 nt, Artificial Sequence
  derived and/or modified sequence opt4 from hemagglutinin__InfluenzaA__AIC73772
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaguguaccagauccuggccaucuacagcaccguggccagcagccuggugcugguggugagccugggcgccaucagcuucuggaugugcagcaacggcagccugcagugcagaaucugcaucuga

SEQ ID NO: 164925 - RNA, 1701 nt, Artificial Sequence; identical to SEQ ID NO: 162560
  derived and/or modified sequence opt4 from hemagglutinin__InfluenzaA__AIC73773

SEQ ID NO: 164926 - RNA, 1701 nt, Artificial Sequence; identical to SEQ ID NO: 162560
  derived and/or modified sequence opt4 from hemagglutinin__InfluenzaA__AIC73775

SEQ ID NO: 164927 - RNA, 1701 nt, Artificial Sequence; identical to SEQ ID NO: 162560
  derived and/or modified sequence opt4 from hemagglutinin__InfluenzaA__AIC73776

SEQ ID NO: 164928 - RNA, 1701 nt, Artificial Sequence; identical to SEQ ID NO: 164924
  derived and/or modified sequence opt4 from hemagglutinin__InfluenzaA__AIC73777

SEQ ID NO: 164929 - RNA, 1701 nt, Artificial Sequence
  derived and/or modified sequence opt4 from hemagglutinin__InfluenzaA__AIC73778
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164930 - RNA, 1701 nt, Artificial Sequence; identical to SEQ ID NO: 164929
  derived and/or modified sequence opt4 from hemagglutinin__InfluenzaA__AIC73779

SEQ ID NO: 164931 - RNA, 1701 nt, Artificial Sequence; identical to SEQ ID NO: 164929
  derived and/or modified sequence opt4 from hemagglutinin__InfluenzaA__AIC73780

SEQ ID NO: 164932 - RNA, 1701 nt, Artificial Sequence; identical to SEQ ID NO: 163518
  derived and/or modified sequence opt4 from hemagglutinin__InfluenzaA__AIC73781

SEQ ID NO: 164933 - RNA, 1701 nt, Artificial Sequence; identical to SEQ ID NO: 164929
  derived and/or modified sequence opt4 from hemagglutinin__InfluenzaA__AIC73782

SEQ ID NO: 164934 - RNA, 1701 nt, Artificial Sequence; identical to SEQ ID NO: 164929
  derived and/or modified sequence opt4 from hemagglutinin__InfluenzaA__AIC73783

SEQ ID NO: 164935 - RNA, 1701 nt, Artificial Sequence; identical to SEQ ID NO: 164929
  derived and/or modified sequence opt4 from hemagglutinin__InfluenzaA__AIC73784

SEQ ID NO: 164936 - RNA, 1701 nt, Artificial Sequence; identical to SEQ ID NO: 162560
  derived and/or modified sequence opt4 from hemagglutinin__InfluenzaA__AIC73785

SEQ ID NO: 164937 - RNA, 1701 nt, Artificial Sequence; identical to SEQ ID NO: 164929
  derived and/or modified sequence opt4 from hemagglutinin__InfluenzaA__AIC73786

SEQ ID NO: 164938 - RNA, 1701 nt, Artificial Sequence; identical to SEQ ID NO: 162560
  derived and/or modified sequence opt4 from hemagglutinin__InfluenzaA__AIC73787

SEQ ID NO: 164939 - RNA, 1701 nt, Artificial Sequence; identical to SEQ ID NO: 162560
  derived and/or modified sequence opt4 from hemagglutinin__InfluenzaA__AIC73788

SEQ ID NO: 164940 - RNA, 1701 nt, Artificial Sequence
  derived and/or modified sequence opt4 from hemagglutinin__InfluenzaA__AIC73789
augaagaccaucaucgcccugagcuacauccugugccugguguucgcccagaagccccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 164941 - RNA, 1701 nt, Artificial Sequence
  derived and/or modified sequence opt4 from hemagglutinin__InfluenzaA__AIC73790
augaaggccauccugguggugcugcuguacaccuucgccaccaccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagacagagcuacaucaacgacaagggcaaggaggugcuggugcuguggggcauccaccaccccagcaccaccaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164942 - RNA, 1701 nt, Artificial Sequence
  derived and/or modified sequence opt4 from hemagglutinin__InfluenzaA__AIC73791
augaaggccauccugguggugcugcuguacaccuucgccaccgccaacgccgacacccugugcaucggcuaccacgccaacaacagcaccgacaccaucgacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164943 - RNA, 1701 nt, Artificial Sequence; identical to SEQ ID NO: 162560
  derived and/or modified sequence opt4 from hemagglutinin__InfluenzaA__AIC73792

SEQ ID NO: 164944 - RNA, 1701 nt, Artificial Sequence; identical to SEQ ID NO: 164924
  derived and/or modified sequence opt4 from hemagglutinin__InfluenzaA__AIC73793

SEQ ID NO: 164945 - RNA, 1701 nt, Artificial Sequence
  derived and/or modified sequence opt4 from hemagglutinin__InfluenzaA__AIC73794
augaagaccaucaucggcgugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcagcugcaucagaggcagcaacagcagcuucuucagcagacugaacuggcugacccaccugaacagcaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164946 - RNA, 1701 nt, Artificial Sequence; identical to SEQ ID NO: 162560
  derived and/or modified sequence opt4 from hemagglutinin__InfluenzaA__AIC73796

SEQ ID NO: 164947 - RNA, 1701 nt, Artificial Sequence
  derived and/or modified sequence opt4 from hemagglutinin__InfluenzaA__AIC73797
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcagcugcaucagaggcagcaacagcagcuucuucagcagacugaacuggcugacccaccugaacagcaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164948 - RNA, 1701 nt, Artificial Sequence; identical to SEQ ID NO: 164947
  derived and/or modified sequence opt4 from hemagglutinin__InfluenzaA__AIC73798

SEQ ID NO: 164949 - RNA, 1701 nt, Artificial Sequence; identical to SEQ ID NO: 164947
  derived and/or modified sequence opt4 from hemagglutinin__InfluenzaA__AIC73800

SEQ ID NO: 164950 - RNA, 1701 nt, Artificial Sequence; identical to SEQ ID NO: 164947
  derived and/or modified sequence opt4 from hemagglutinin__InfluenzaA__AIC73801

SEQ ID NO: 164951 - RNA, 1701 nt, Artificial Sequence; identical to SEQ ID NO: 164947
  derived and/or modified sequence opt4 from hemagglutinin__InfluenzaA__AIC73802

SEQ ID NO: 164952 - RNA, 1701 nt, Artificial Sequence; identical to SEQ ID NO: 164947
  derived and/or modified sequence opt4 from hemagglutinin__InfluenzaA__AIC73803

SEQ ID NO: 164953 - RNA, 1701 nt, Artificial Sequence; identical to SEQ ID NO: 164947
  derived and/or modified sequence opt4 from hemagglutinin__InfluenzaA__AIC73804

SEQ ID NO: 164954 - RNA, 1701 nt, Artificial Sequence; identical to SEQ ID NO: 164947
  derived and/or modified sequence opt4 from hemagglutinin__InfluenzaA__AIC73805

SEQ ID NO: 164955 - RNA, 1701 nt, Artificial Sequence; identical to SEQ ID NO: 164947
  derived and/or modified sequence opt4 from hemagglutinin__InfluenzaA__AIC73806

SEQ ID NO: 164956 - RNA, 1701 nt, Artificial Sequence
  derived and/or modified sequence opt4 from hemagglutinin__InfluenzaA__AIC73807
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacaacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164957 - RNA, 1701 nt, Artificial Sequence; identical to SEQ ID NO: 164947
  derived and/or modified sequence opt4 from hemagglutinin__InfluenzaA__AIC73808

SEQ ID NO: 164958 - RNA, 1701 nt, Artificial Sequence
  derived and/or modified sequence opt4 from hemagglutinin__InfluenzaA__AIC73809
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagacagagcuacaucaacgacaagggcaaggaggugcuggugcuguggggcauccaccaccccagcaccaccaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacgaggugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164959 - RNA, 1701 nt, Artificial Sequence
  derived and/or modified sequence opt4 from hemagglutinin__InfluenzaA__AIC73810
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacagaugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164960 - RNA, 1701 nt, Artificial Sequence
  derived and/or modified sequence opt4 from hemagglutinin__InfluenzaA__AIC73813
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccgccgccagcagccuggugcuggugaucagccugggcgccaucagcuucuggaugugcagcaacggcagccugcagugcagaaucugcaucuga

SEQ ID NO: 164961 - RNA, 1701 nt, Artificial Sequence
  derived and/or modified sequence opt4 from hemagglutinin__InfluenzaA__AIC73815
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164962 - RNA, 1701 nt, Artificial Sequence; identical to SEQ ID NO: 164440
  derived and/or modified sequence opt4 from hemagglutinin__InfluenzaA__AIC73817

SEQ ID NO: 164963 - RNA, 1701 nt, Artificial Sequence; identical to SEQ ID NO: 162560
  derived and/or modified sequence opt4 from hemagglutinin__InfluenzaA__AIC73819

SEQ ID NO: 164964 - RNA, 1701 nt, Artificial Sequence
  derived and/or modified sequence opt4 from hemagglutinin__InfluenzaA__AIC73820
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacaucgaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164965 - RNA, 1701 nt, Artificial Sequence; identical to SEQ ID NO: 162560
  derived and/or modified sequence opt4 from hemagglutinin__InfluenzaA__AIC73821

SEQ ID NO: 164966 - RNA, 1701 nt, Artificial Sequence; identical to SEQ ID NO: 164924
  derived and/or modified sequence opt4 from hemagglutinin__InfluenzaA__AIC73824

SEQ ID NO: 164967 - RNA, 1701 nt, Artificial Sequence; identical to SEQ ID NO: 162560
  derived and/or modified sequence opt4 from hemagglutinin__InfluenzaA__AIC73825

SEQ ID NO: 164968 - RNA, 1701 nt, Artificial Sequence
  derived and/or modified sequence opt4 from hemagglutinin__InfluenzaA__AIC73827
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagccccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccugauccugguggugagccugggcgccaucagcuucuggaugugcagcaacggcagccugcagugcagaaucugcaucuga

SEQ ID NO: 164969 - RNA, 1701 nt, Artificial Sequence
  derived and/or modified sequence opt4 from hemagglutinin__InfluenzaA__AIC73828
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaccaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 164970 - RNA, 1701 nt, Artificial Sequence
  derived and/or modified sequence opt4 from hemagglutinin__InfluenzaA__AIC73830
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugaagggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164971 - RNA, 1701 nt, Artificial Sequence
  derived and/or modified sequence opt4 from hemagglutinin__InfluenzaA__AIC73833
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 164972 - RNA, 1701 nt, Artificial Sequence
  derived and/or modified sequence opt4 from hemagglutinin__InfluenzaA__AIC73834
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgacggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccggccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164973 - RNA, 1701 nt, Artificial Sequence
  derived and/or modified sequence opt4 from hemagglutinin__InfluenzaA__AIC73835
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagccuguggaugugcagcaacggcagccugcagugcagaaucugcaucuga

SEQ ID NO: 164974 - RNA, 1701 nt, Artificial Sequence; identical to SEQ ID NO: 164916
  derived and/or modified sequence opt4 from hemagglutinin__InfluenzaA__AIC73836

SEQ ID NO: 164975 - RNA, 1701 nt, Artificial Sequence
  derived and/or modified sequence opt4 from hemagglutinin__InfluenzaA__AIC73837
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164976 - RNA, 1701 nt, Artificial Sequence
  derived and/or modified sequence opt4 from hemagglutinin__InfluenzaA__AIC73838
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggaccugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164977 - RNA, 1701 nt, Artificial Sequence
  derived and/or modified sequence opt4 from hemagglutinin__InfluenzaA__AIC73839
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaccggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164978 - RNA, 1701 nt, Artificial Sequence; identical to SEQ ID NO: 162560
  derived and/or modified sequence opt4 from hemagglutinin__InfluenzaA__AIC73840

SEQ ID NO: 164979 - RNA, 1701 nt, Artificial Sequence
  derived and/or modified sequence opt4 from hemagglutinin__InfluenzaA__AIC73841
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaucgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164980 - RNA, 1701 nt, Artificial Sequence; identical to SEQ ID NO: 164975
  derived and/or modified sequence opt4 from hemagglutinin__InfluenzaA__AIC73842

SEQ ID NO: 164981 - RNA, 1707 nt, Artificial Sequence
  derived and/or modified sequence opt4 from hemagglutinin__InfluenzaA__AID48082
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaaccaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacgacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 164982 - RNA, 1701 nt, Artificial Sequence
  derived and/or modified sequence opt4 from hemagglutinin__InfluenzaA__AID70444
augaaggccgugcugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccuggccaccgccagcagcuggagcuacaucguggagaccagcaacagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcagagaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcugguggugcuggagaacgagagaacccuggaguaccacgacagcaacgugaagaaccuguacgagaaggugagaagccaggugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcuucaacggcagccugcagugcagaaucuacaucuga

SEQ ID NO: 164983 - RNA, 1701 nt, Artificial Sequence
  derived and/or modified sequence opt4 from hemagglutinin__InfluenzaA__AID70445
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcugguggugcuggagaacgagagaacccuggaguaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaucuacgacuaccccaaguacagcgaggaggccaagcugaacagagaggagaucgacggcgugaagcuggagagcaccagaaucuaccagauccuggccaucuacagcaccguggccagcagccuggugcagguggugagccugggcgccaucagcuucuggaugugcuucaacggcagccugcagugcagaaucugcaucuga

SEQ ID NO: 164984 - RNA, 1701 nt, Artificial Sequence
  derived and/or modified sequence opt4 from hemagglutinin__InfluenzaA__AID70446
augaaggccgugcugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggagauccuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcggcacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcugguggugcuggagaacgagagaacccuggaguaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaucuacgacuaccccaaguacagcgaggaggccaagcugaacagagaggagaucgacggcgugaagcuggagagcaccagaaucuaccagauccuggccaucuacagcaccguggccagcagccuggugcagguggugagccugggcgccaucagcuucuggaugugcuucaacggcagccugcagugcagaaucugcaucuga

SEQ ID NO: 164985 - RNA, 1701 nt, Artificial Sequence
  derived and/or modified sequence opt4 from hemagglutinin__InfluenzaA__AID70447
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccaggccggcgccaagggcuucuacaagaaccugcuguggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccagcgugggcaaggaguucaaccaccuggagaagagaauggagaaccugaacaagaagguggacgacggcuuccuggacaucuggaccuacaacgccgagcugcugguggugcuggagaacgagagaacccuggaguaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaucuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcuucaacggcagccugcagugcagaaucugcaucuga

SEQ ID NO: 164986 - RNA, 1701 nt, Artificial Sequence
  derived and/or modified sequence opt4 from hemagglutinin__InfluenzaA__AID70448
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcugguggugcuggagaacgagagaacccuggaguaccaggacagcaacgugaagaaccuguacgagaaggugagaaaccagcugaagaacaacgccaaggagaucggcaacggcugccuggaguucuaccacaaguucgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcaccaucagcuucuggaugugcuucaacggcagccugcagugcagaaucugcaucuga

SEQ ID NO: 164987 - RNA, 1701 nt, Artificial Sequence
  derived and/or modified sequence opt4 from hemagglutinin__InfluenzaA__AID70449
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcugguggugcuggagaacgagagaacccuggaguaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcuucaacggcagccugcagugcagaaucugcguguga

SEQ ID NO: 164988 - RNA, 1701 nt, Artificial Sequence
  derived and/or modified sequence opt4 from hemagglutinin__InfluenzaA__AID70450
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagaccagcaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcugguggugcuggagaacgagagaacccuggaguaccacgacagcaacgugaagaaccuguacgagaaggugagaaaccagcugaagaacaacgccaaggagaucggcaacggcugcuucgaguucuaccacaaguucgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcagguggugagccugggcgccaucagcuucuggaugugcuucaacggcagccugcagugcagaaucugcaucuga

SEQ ID NO: 164989 - RNA, 1701 nt, Artificial Sequence
  derived and/or modified sequence opt4 from hemagglutinin__InfluenzaA__AID70451
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcugguggugcuggagaacgagagaacccuggaguaccacgacagcaacgugaagaaccuguacgagaaggugagaaaccagcugaagaacaacgccaaggagaucggcaacggcugcuucgaguucuaccacaaguucgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcuucaacggcagccugcagugcagaaucugcaucuga

SEQ ID NO: 164990 - RNA, 1701 nt, Artificial Sequence
  derived and/or modified sequence opt4 from hemagglutinin__InfluenzaA__AID70452
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugggcagcgugagcagcuucaagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcugguggugcuggagaacgagagaacccuggaguaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaucuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugagauucaacggcagccugcagugcagcaucugcaucuga

SEQ ID NO: 164991 - RNA, 1701 nt, Artificial Sequence
  derived and/or modified sequence opt4 from hemagglutinin__InfluenzaA__AID70453
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcaggacugcaacaccaccugccagacccccaagggcgccaucaacaccagccugcccuuccagaacauccaccccaucaccaucggcaagugccccaaguacgugaagagcaccaagcugagacuggugaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcugguggugcuggagaacgagagaacccuggaguaccacgacagcaaccugaagaaccuguacgagaaggugagaaaccagcugaagaacaacgccaaggagaucggcaacggcugcuucgaguucuaccacaaguucgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcagguggugagccugggcgccaucagcuucuggaugagauucaacggcagccugcacugcagaaucugcaucuga

SEQ ID NO: 164992 - RNA, 1701 nt, Artificial Sequence
  derived and/or modified sequence opt4 from hemagglutinin__InfluenzaA__AID70454
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagaugagacuggccaccggccugagaaacgugcccugcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcugguggugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 164993 - RNA, 1701 nt, Artificial Sequence
  derived and/or modified sequence opt4 from hemagglutinin__InfluenzaA__AID70455
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugggcggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagaucagcaagagcuacaucaacgacaagggcaaggaggugcuggugcuguggggcauccaccaccccagcaccaccgccgaccagcagagccuguaccagaacgccgacaccuacaucuucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucaagaagaugaacacccaguucaccgccgugggcaaggaguucaaccaccuggagaagagaaucgagaaccugaacaagaagguggacgacggcuuccuggacaucuggaccuacaacgccgagcugcugguggugcuggagaacgagagaacccuggaguaccacgacagcaacgugaagaaccuguacgagaaggugagaaaccagcugaagaacaacgccaaggagaucggcaacggcugcuucgaguucuaccacaaguucgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcuucaacggcagccugcagugcagaaucugcaucuga

SEQ ID NO: 164994 - RNA, 1701 nt, Artificial Sequence
  derived and/or modified sequence opt4 from hemagglutinin__InfluenzaA__AID70456
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccguggugaaggaguucaaccaccuggagaagagaaucgagaaccugaacaagaagguggacgacggcuuccuggacaucuggaccuacaacgccgagcugcugguggugcuggagaacgagagaacccuggaguaccacgacagcaaccugaagaaccuguacgagaaggugagaaaccagcugaagaacaacgccaaggagaucggcaacggcugcuucgaguucuaccacaaguucgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcagguggugagccugggcgccaucagcuucuggaugugcuucaacggcagccugcagugcagaaucugcaucuga

SEQ ID NO: 164995 - RNA, 1701 nt, Artificial Sequence
  derived and/or modified sequence opt4 from hemagglutinin__InfluenzaA__AID70457
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcugguggugcuggagaacgagagaacccuggaguaccacgacagcaacgugaagaaccuguacgagaaggugagaaaccagcugaagaacaacgccaaggagaucggcaacggcugcuucgaguucuaccacaaguucgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcagguggugagccugggcgccaucagcuucuggaagugcuucaacggcagccugcagugcagaaucugcagcuga

SEQ ID NO: 164996 - RNA, 1701 nt, Artificial Sequence
  derived and/or modified sequence opt4 from hemagglutinin__InfluenzaA__AID70458
augaagaccaucaucgcccugagcuacauccugugccugguguucgcccagaaguuccccggcaacgacaacagcauggccacccugugccugggccaccacgccgugcccaacggcaccauggugaagaccaucaccaacgaccagaucgaggugaccaacgccaccgagcuggugcagagcagcagcaccggcggcaucugcaacagcccccaccagauccuggacggcggcaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagcaucguggccagcagcggcacccuggaguucaacaacgagagcuucaacuggaccggcgugacccagaacggcaagagcgccagcugcaagagaggcagcgacaacagcuucuucagcagacugaacuggcugacccaccugaacuacaaguaccccgcccugaaggugaccaugcccaacaacgagaaguucgacaagcuguacaucuggggcgugcaccaccccggcaccuacaacgaccagaucagccuguacgcccaggccagcggcaucaucaccgugagcaccaagagaaaccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaugggccaggccgccgaccugaagagcacccaggccgccaucaaccagaucaacggcaagcugaacagacugaucggcaagaccaucgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagauggacaagcuguucgagagaaccaagaagcagaugagagagaacgccgaggacaugggcaacggcugcuucaagaucuaccacaagugcgacaacgccugcaucggcagcaucagaaacggcaucuacgacagagacaucuacagagacgaggcccugagcaacagauuccagaucaagggcguggagcugaaggccggcuacaaggacuggauccuguggaucagcuucgccaucagcugcuuccugcugugcguggugcugcugggcuucaucaugugggccugccagaagggcaaccugagaugcaacaucugcaucuga

SEQ ID NO: 164997 - RNA, 1701 nt, Artificial Sequence
  derived and/or modified sequence opt4 from hemagglutinin__InfluenzaA__AID70459
augaagaccaucaucgcccugagcuacauccugugccugguguucgcccagaaggugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagaagagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggcccccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaucgagaaguuccaccagaucgagaacgaguucagcgagguggagggcagaauccaggaccuggagaaguacguggaggacaccaagaucgaccuguggagcuacaucgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaucuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164998 - RNA, 1701 nt, Artificial Sequence
  derived and/or modified sequence opt4 from hemagglutinin__InfluenzaA__AID70460
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagaagagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaucgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaucuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 164999 - RNA, 1701 nt, Artificial Sequence
  derived and/or modified sequence opt4 from hemagglutinin__InfluenzaA__AID70461
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagaagagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaucgagaaguuccaccagaucgagaaggaguucagcgagguggagggcagaauccaggaccuggagaaguacaucgaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaucuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaucaccugcaucuga

SEQ ID NO: 165000 - RNA, 1701 nt, Artificial Sequence
  derived and/or modified sequence opt4 from hemagglutinin__InfluenzaA__AID70463
augaagaccaucaucgcccugagcuacauccugugccugguguucgcccagaagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagaagagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaucgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaucuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165001 - RNA, 1701 nt, Artificial Sequence
  derived and/or modified sequence opt4 from hemagglutinin__InfluenzaA__AID70464
augaagaccaucaucgcccugagcuacauccugugccugguguucgcccagaagcugcccggcgacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagaagagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaucgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165002 - RNA, 1701 nt, Artificial Sequence
  derived and/or modified sequence opt4 from hemagglutinin__InfluenzaA__AID70465
augaagaccaucaucgcccugagcuacauccugugccugguguucgcccagaagcugcccggcgacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagaagagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaucgagaaguuccaccagaucgagaaggaguucagcgagguggagggcagaauccaggaccuggagaaguacguggaggacaccaagaucgaccuguggagcuacaacgccgagcugcugguggcccuggagaaccaccacgccaucgaccugaccgacagcgagaugaacaagcuguucgagaagaccaagaagcagaugagagagaacgccgaggacaugggcaacggcugcuucaagaucuaccugaagugcgacaacgccugcaucggcagcaucagaaacggcaucuacgaccacgacguguacagagacgaggcccugaacaacagauuccagaucaagggcguggagcugaagagcggcuacaaggacuggauccuguggaucagcuucaccgagagcugcuuccugcugugcguggcccugcugggcuucaucaugugggccugccagaagggcaacaucagaugcaacaucugcaucuga

SEQ ID NO: 165003 - RNA, 1701 nt, Artificial Sequence
  derived and/or modified sequence opt4 from hemagglutinin__InfluenzaA__AID70466
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagaagagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaucgagaaguuccaccagaucgagaacgaguucagcgagguggagggcagaauccaggaccuggagaaguacguggaggacaccaagaucgaccuguggagcuacaucggcgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaucuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165004 - RNA, 1701 nt, Artificial Sequence
  derived and/or modified sequence opt4 from hemagglutinin__InfluenzaA__AID70467
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagaagagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacugcgagggcagaggccaggccgccgaccugaagagcacccaggccgccaucgaccagaucaacggcaagcugaacagacugaucggcaagaccaucgagaaguuccaccagaucgagaacgaguucagcgagguggagggcagaauccagggccuggagaaguacguggaggacaccaagaucgaccuguggagcuacaucgccgagcugaucguggcccuggagaaccagcacaccaucgaccugaccgacagcgagaugaacaagcuguucgagaagaccaagaagcagaugagagagaacgccgaggacaugggcaacggcugcuucaagaucuaccacaagugcgacaacgccugcaucggcagcaucagaaacggcaucuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165005 - RNA, 1701 nt, Artificial Sequence
  derived and/or modified sequence opt4 from hemagglutinin__InfluenzaA__AID70468
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacugcgagggcagaggccaggccgccgaccugaagagcacccaggccgccaucgaccagaucaacggcaagcugaacagacugaugggcaagagcaucgagaaguuccaccagaucgagaacgaguucagcgagguggagggcagaauccagggccuggagaaguacguggaggacaccaagaucgaccuguggagcuacaacggcgagcugaucguggcccuggagaaccagcacgccaucgaccugaccgacagcgagaugaacaagcuguucgagaagaccaagaagcagaugagagagaacgccgaggacaugggcaacggcugcuucaagaucuaccugaagugcgacaacgccugcaucggcagcaucagaaacggcaucuacgaccacgacguguacagagacgaggcccugaacaacagauuccagaucaagggcguggagcugaagagcggcuacaaggacuggauccuguggaucagcuucaccaucagcugcuuccugcugugcguggcccugcugggcuucaucaugugggccagacagaagggcaacaucagaugcaacaucugcaucuga

SEQ ID NO: 165006 - RNA, 1701 nt, Artificial Sequence
  derived and/or modified sequence opt4 from hemagglutinin__InfluenzaA__AID70469
augaagaccaucaucgcccugagcuacauccugugccugguguucgcccagaaggugcccggcaacgagaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacugcgagggcagaggccaggccgccgaccugaagagcacccaggccgccaucgaccagaucaacggcaagcugaacagacugaucggcaagaccaucgagaaguuccaccagaucgagaaggaguucagcgagguggagggcagaauccagggccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagaugagagagaacgccgaggacaugggcaacggcugcuucaagaucuaccacaagugcgacaacgccugcaucggcagcaucagaaacggcaucuacgaccacgacguguacagagacgaggcccugaacaacagauuccagaucaagggcguggagcugaagagcggcuacaaggacuggauccuguggaucagcuucaccaucagcugcuuccugcugugcguggcccugcugggcuucaucaugugggccugccagaagggcaacaucagaugcaacaucugcaucuga

SEQ ID NO: 165007 - RNA, 1701 nt, Artificial Sequence
  derived and/or modified sequence opt4 from hemagglutinin__InfluenzaA__AID70470
augaagaccaucaucgcccugagcuacauccugugccugguguucgcccagaaggugcccggcaacgagaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacugcgagggcagaggccaggccgccgaccugaagagcacccaggccgccaucgaccagaucaacggcaagcugaacagacugaucggcaagaccaucgagaaguuccaccagaucgagaaggaguucagcgagguggagggcagaauccagggccuggagaaguacguggaggacaccaagaucgaccuguggagcuacaacggcgagcugcugguggcccuggagaaccaccacaccaucgaccugaccgacagcgagaugaacaagcuguucgagaagaccaagaagcagaugagagagaacgccgaggacaugggcaacggcugcuucaagaucuaccacaagugcgacaacgccugcaucggcagcaucagaaacggcaucuacgaccacgacguguacagagacgaggcccugaacaacagauuccagaucaagggcguggagcugaagagcggcuacaaggacuggauccuguggaucagcuucaccaucagcugcuuccugcugugcguggcccugcugggcuucaucaugugggccugccagaagggcaacaucagaugcaacaucugcaucuga

SEQ ID NO: 165008 - RNA, 1701 nt, Artificial Sequence
  derived and/or modified sequence opt4 from hemagglutinin__InfluenzaA__AID70471
augaagaccaucaucgcccugagcuacauccugugccugguguucacccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagaagagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaucgagaaguuccaccagaucgagaacgaguucagcgagguggagggcagaauccaggaccuggagaaguacguggaggacaccaagaucgaccuguggagcuacaacgccgagcugaucguggcccuggagaaccaccacaccaucgaccugaccgacagcgagaugaacaagcuguucgagaagaccaagaagcagaugagagagaacgccgaggacaugggcaacggcugcuucaagaucuaccacaagugcgacaacgccugcaucggcagcaucagaaacggcaucuacgaccacgacguguacagagacgaggcccugaacaacagauuccagaucaagggcguggagcugaagagcggcuacaaggacuggauccuguggaucagcuucgccaucagcugcuuccugaucugcguggcccugcugggcuucaucaugugggccugccagaagggcaaccugagaugcaacaucugcaucuga

SEQ ID NO: 165009 - RNA, 1701 nt, Artificial Sequence
  derived and/or modified sequence opt4 from hemagglutinin__InfluenzaA__AID70472
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagaagagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaucgagaaguuccaccagaucgagaaggaguucagcgagguggagggcagaauccaggaccuggagaaguacguggaggacaccaagaucgaccuguggagcuacaacgccgagcugcugguggcccuggagaaccaccacaccaucgaccugaccgacagcgagaugaacaagcuguucgagaagaccaagaagcagaugagagagaacgccgaggacaugggcaacggcugcuucaagaucuaccacaagugcgacaacgccugcaucggcagcaucagaaacggcaucuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165010 - RNA, 1701 nt, Artificial Sequence
  derived and/or modified sequence opt4 from hemagglutinin__InfluenzaA__AID70473
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagaagagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacugcgagggcagaggccaggccgccgaccugaagagcacccaggccgccaucgaccagaucaacggcaagcugaacagacugaucggcaagaccaucgagaaguuccaccagaucgagaaggaguucagcgagguggagggcagaauccagggccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagaugagagagaacgccgaggacaugggcaacggcugcuucaagaucuaccacaagugcgacaacgccugcaucggcagcaucagaaacggcaucuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165011 - RNA, 1701 nt, Artificial Sequence
  derived and/or modified sequence opt4 from hemagglutinin__InfluenzaA__AID70474
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagaagagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacgugugggagggcaugguggacggcugguucggcuucagacaccagaucugcgagggcagaggccaggccgccggccuggagagcacccaggccgccaucgaccagaucaacggcaagaugaacagacugaugggcaagaccaucggcaaguuccaccagaucgugaacgaguucagcgagguggagggcagaauccaggaccuggagaaguacguggaggacaccaagaucgaccuguggagcuacaucggcgagcugcugguggcccuggagaaccaccacgccaucgaccugaccgacagcgagaugaacaagcuguucgagaagaccaagaagcagaugagagagaacgccgaggacaugggcaacggcugcuucaagaucuaccacaagugcgacaacgccugcaucggcagcaucagaaacggcaucuacgacagagacguguacagagacgaggcccugaacaacagauuccacaucaagggcguggagcugaagagcggcuacaaggacuggaucaucuggaucagcagcaccgagagcugcuuccugcugugcguggcccugcugggcuucaucaugugggccugccagaagggcaacaucagaagcaacaucugcaucuga

SEQ ID NO: 165012 - RNA, 1701 nt, Artificial Sequence
  derived and/or modified sequence opt4 from hemagglutinin__InfluenzaA__AID70475
augaagaccaucaucgcccugagcuacaugcugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagaagagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacgugugggagggcaugguggacggcugguacggcuucagacaccagaacugcgagggcagaggccaggccgccgaccugaagagcgcccaggccgccaucgaccccaucaacggcaagcugaacagacugaugggcaagaccaucggcaaguuccaccagaucgagaaggaguucagcgagguggagggcagaauccaggaccuggagaaguacguggaggacaccaagaucgaccuguggagcuacaacggcgagcugcugguggcccuggagaaccagcacgccaucgaccugaccgacagcgagaugaacaagguguucgagaagaccaagaagcagcugagagagaacgccgaggacaugggcaacggcugcuucaagaucuaccacaagugcgacaacgccugcaucggcagcaucagaaacggcaucuacgaccacgacguguacagaaacgaggcccugaacaacagauuccagaucaagggcguggagcugaagagcggcuacaaggacuggauccuguggaucagcuucgccaucagcugcuuccugcugagcguggccagccugggcuucaucaugugggccuaccagaagggcaacaucagaugcaacaucugcaucuga

SEQ ID NO: 165013 - RNA, 1701 nt, Artificial Sequence
  derived and/or modified sequence opt4 from hemagglutinin__InfluenzaA__AID70476
augaagaccaucaucgcccugagcuacauccugugccugguguucgcccagaagcugcccggcaacgagaacagcaccgccacccugggccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacgacuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagaagagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacaaccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaucgagaaguuccaccagaucgagaaggaguucagcgagguggagggcagaauccagggcagagagaaguacguggaggacaccaagaucgaccuguggagcuacaucggcgaguucaucguggcccuggagaaccagcacaccaucgaccugaccgacagcgagaugaacaagcuguucgagaagaccaagaagcagaugagagagaacgccgaggacaugggcaacggcugcuucaagaucuaccacaagugcgacaacgccugcaucggcagcaucagaaacggcaucuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165014 - RNA, 1701 nt, Artificial Sequence
  derived and/or modified sequence opt4 from hemagglutinin__InfluenzaA__AID70477
augaagaccaucaucgcccugagcuacauccugugccugguguucgcccagaagcugcccggcaacgacagcagcaccggcacccugugccugggccaccacgccgugcccaacggcaccaucgugaagaccaucaccaacgaccagaucgaggugaccaacgccaccgagcuggugcagagcagcagcaccggcgagaucugcaacagaccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcauccugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagaagagccagcaggccgugauccccaacaucggcagcagacccagagugagaaacauccccagcagagugagcaucuacuggaccaucgugaagcccggcgagauccugcugaucaacagcaccggcaaccugaucgcccccagaggcuacuucaagaucagaagcggcaagagcagcaucaugagaagcgacgcccccaucggcaagugcuacagcgccugcaucacccccaacggcagcauccccaacgacaagcccuuccagaacgugaacagaaucaccuacggcgccugccccagauacgugaagcagcacccccugaagcuggccaccggcaugagaaacgugcccgagaagcagaccagaggcaucuucggcgccaucgccggcuucaucgagaacggcugggagggcaugguggacggcugguacggcuucagacaccagaucugcgagggcagaggccaggccgccgaccugaagagcacccaggccgccaucgaccagaucaacggcaagcugaacagacugaucggcaagaccaucgagaaguuccaccagaucgagaaggaguucagcgagguggaguggagaauccagggccuggagaaguacguggaggacaccaagguggaccuguggagcuacaacggcgagcugaucguggcccuggagaaccaccacaccaucgaccugaccgacagcgagaugaacaagcuguucgagaagaccaagaagcagaugagagagaacgccgaggacaugggcaacggcugcuucaagaucuaccugaagugcgacaacgccugcaucggcagcaucagaaacggcaucuacgaccacgacguguacagagacgaggcccugaacaacagauuccagaucaagggcguggagcugaagagcggcuacaaggacuggauccuguggaucagcuucaccgagagcugcuuccugcugagcguggcccugcugggcuucaucaugugggccugccagaagggcaacaucagaugcaacaucugcaucuga

SEQ ID NO: 165015 - RNA, 1701 nt, Artificial Sequence
  derived and/or modified sequence opt4 from hemagglutinin__InfluenzaA__AID70478
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagaagagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacugcgagggcagaggccaggccgccgaccuggagagcacccaggccgccaucgaccagaucaacggcaagaugaacagacugaugggcaagaccaucgagaaguuccaccagaucgagaaggaguucagcgagguggagggcagaauccagggcagagagaaguacguggaggacaccaagaucgaccuguggagcuacaacggcgagcugcugguggaccuggagaaccagcacaccaucgaccugaccgacagcgagaugaacaagguguucgagaagaccaagaagcagaugagagagaacgccgaggacaugggcaacggcugcuucaagaucuaccacaagugcgacaacgccugcaucggcagcaucagaaacggcaucuacgaccacgacguguacagagacgaggcccugaacaacagauuccagaucaagggcguggagcugaagagcggcuacaaggacuggauccaguggaucagcuucaccaucagcugcuuccugcugugcgugagccugcugggcuucaucaugugggccugccagaagggcaacaucagaugcaacaucugcaucuga

SEQ ID NO: 165016 - RNA, 1701 nt, Artificial Sequence; identical to SEQ ID NO: 162560
  derived and/or modified sequence opt4 from hemagglutinin__InfluenzaA__AID70632

SEQ ID NO: 165017 - RNA, 1683 nt, Artificial Sequence
  derived and/or modified sequence opt4 from hemagglutinin__InfluenzaA__AID70634
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcgccaccagcgccugcagaagaagcggcagcagcuucuacgccgagaugaaguggcugcugagcaacaccgacaacgccgccuucccccagaugaccaagagcuacaagaacaccagaaagagccccgcccugaucguguggggcauccaccacagcgugagcaccgccgagcagaccaagcuguacggcagcggcaacaagcuggugaccgugggcagcagcaacuaccagcagagcuucgugcccagccccggcgccagaccccaggugaacggccugagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagagccgugggcaagugccccagauacgugaagcagagaagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagaaucaucgagaagaccaaccagcaguucgagcugaucgacaacgaguucaacgagguggagaagcagaucagcaacgugaucaacuggaccagagacagcaucaccgagguguggagcuacaacgccgagcugcugguggccauggagaaccagcacaccaucgaccuggccgacagcgagauggacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgugaugggccugguguucaucugcgugaagaacggcaacaugagaugcaccaucugcaucuga

SEQ ID NO: 165018 - RNA, 1701 nt, Artificial Sequence
  derived and/or modified sequence opt4 from hemagglutinin__InfluenzaA__AIF72902
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcgccggcgagaucugcgacagcccccaccagauccuggacggcgagaacugcacccugaucgacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165019 - RNA, 1701 nt, Artificial Sequence
  derived and/or modified sequence opt4 from hemagglutinin__InfluenzaA__AIF72903
augaagaccaucaucgcccugagcuacauccugugccugguguucgcccaggagcugcccggcaacgacaacagcaccgccacccugugccugggccaccacgccgugcccaacggcaccaucgugaagaccaucaccaacgaccagaucgaggugaccaacgccaccgagcuggugcagagcagcagcgccggcgagaucugcgacagcccccaccagauccuggacggcgagaacugcacccugaucgacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugggugcuguggaucagcuucgccaucagcugcuuccugcugugcguggcccugcugggcuucaucaugugggccugccagaagggcaacaucagaugcaacaucugcaucuga

SEQ ID NO: 165020 - RNA, 1701 nt, Artificial Sequence
  derived and/or modified sequence opt4 from hemagglutinin__InfluenzaA__AIF72904
augaagaccaucaucgcccugagcuacauccugugccugguguucgcccaggagcugcccggcaacgacaacagcaccgccacccugugccugggccaccacgccgugcccaacggcaccaucgugaagaccaucaccaacgaccagaucgaggugaccaacgccaccgagcuggugcagagcagcagcgccggcgagaucugcgacagcccccaccagauccuggacggcgagaacugcacccugaucgacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugggugcuguggaucagcuucgccaucagcugcuuccugcugugcguggcccugcugggcuucaucaugugggccugccagaagggcaacaucagaugcaacaucugcaucuga

SEQ ID NO: 165021 - RNA, 1701 nt, Artificial Sequence
  derived and/or modified sequence opt4 from hemagglutinin__InfluenzaA__AIF72905
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcgccggcgagaucugcgacagcccccaccagauccuggacggcgagaacugcacccugaucgacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaagaacgagagcuucaacuggaccggcgugacccagaacggcaccagcagcgccugcaucagaagaagcaacaacagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165022 - RNA, 1701 nt, Artificial Sequence; identical to SEQ ID NO: 155931
  derived and/or modified sequence opt4 from hemagglutinin__InfluenzaA__AIF72906

SEQ ID NO: 165023 - RNA, 1701 nt, Artificial Sequence; identical to SEQ ID NO: 155931
  derived and/or modified sequence opt4 from hemagglutinin__InfluenzaA__AIF72907

SEQ ID NO: 165024 - RNA, 1701 nt, Artificial Sequence; identical to SEQ ID NO: 155931
  derived and/or modified sequence opt4 from hemagglutinin__InfluenzaA__AIF72908

SEQ ID NO: 165025 - RNA, 1701 nt, Artificial Sequence
  derived and/or modified sequence opt4 from hemagglutinin__InfluenzaA__AIF72909
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcgccggcgagaucugcgacggcccccaccagauccuggacggcgagaacugcacccugaucgacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaacaacgagagcuucaacuggaccggcaccacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165026 - RNA, 1701 nt, Artificial Sequence; identical to SEQ ID NO: 155931
  derived and/or modified sequence opt4 from hemagglutinin__InfluenzaA__AIF72910

SEQ ID NO: 165027 - RNA, 1701 nt, Artificial Sequence; identical to SEQ ID NO: 155931
  derived and/or modified sequence opt4 from hemagglutinin__InfluenzaA__AIF72911

SEQ ID NO: 165028 - RNA, 1701 nt, Artificial Sequence; identical to SEQ ID NO: 165018
  derived and/or modified sequence opt4 from hemagglutinin__InfluenzaA__AIF72912

SEQ ID NO: 165029 - RNA, 1701 nt, Artificial Sequence; identical to SEQ ID NO: 155931
  derived and/or modified sequence opt4 from hemagglutinin__InfluenzaA__AIF72913

SEQ ID NO: 165030 - RNA, 1701 nt, Artificial Sequence
  derived and/or modified sequence opt4 from hemagglutinin__InfluenzaA__AIF72914
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaggcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccacgaccuggagaaguacguggaggacacccuguucgaccuguggguguacaacagcgagcugcugguggcccugcagaaccagcacaccaucgaccugcccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165031 - RNA, 1701 nt, Artificial Sequence
  derived and/or modified sequence opt4 from hemagglutinin__InfluenzaA__AIF72915
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccugcagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165032 - RNA, 1701 nt, Artificial Sequence; identical to SEQ ID NO: 155931
  derived and/or modified sequence opt4 from hemagglutinin__InfluenzaA__AIF72916

SEQ ID NO: 165033 - RNA, 1701 nt, Artificial Sequence
  derived and/or modified sequence opt4 from hemagglutinin__InfluenzaA__AIF72917
augaagaccaucaucgcccugagcuacauccugugccugguguucgcccagaagcugcccagaaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaagaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcgacaucugcaucuga

SEQ ID NO: 165034 - RNA, 1683 nt, Artificial Sequence
  derived and/or modified sequence opt4 from hemagglutinin__InfluenzaA__AIG44693
auggagaccgccagccugaucaccauccugcugguggugaccgugagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccagccugggccagccccugauccuggacaccugcaccaucgagggccugaucuacggcaaccccagcugcgaccugcugcugggcggcagagaguggagcuacaucguggagagacccagcgccgugaacggccugugcuaccccggcaacguggagaaccuggaggagcugagaagccuguucagcagcgccagaagcuaccagagaauccagaucuuccccgacaccaucuggaacgugagcuacagcggcaccagcaaggccugcagcgacagcuucuacagaagcaugagauggcugacccagaaggacaacgccuaccccauccaggacgcccaguacaccaacaaccaggagaagaacauccuguucauguggggcaucaaccacccccccaccgacaccgcccagaccaaccuguacaccagaaccgacaccaccaccagcguggccaccgaggagaucaacagaaccuucaagccccugaucggccccagaccccuggugcacggccugaugggcagaaucaacuacuacuggagcgugcugaagcccggccagacccugagaaucaagagcaacggcaaccugaucgcccccugguacggccacauccugagcggcaagagccacggcagaauccugaagaccgaccugaagagaggcaacugcaccgugcagugccagaccgagaagggcggccugaacaccacccugcccuuccagaacgugagcaaguacgccuucggcaacugcagcaaguacaucggcaucaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaagaaaguaccaggaggagagcaagcuggagaagcagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 165035 - RNA, 1701 nt, Artificial Sequence; identical to SEQ ID NO: 159502
  derived and/or modified sequence opt4 from hemagglutinin__InfluenzaA__AIJ10728

SEQ ID NO: 165036 - RNA, 1701 nt, Artificial Sequence
  derived and/or modified sequence opt4 from hemagglutinin__InfluenzaA__AIJ10729
augaagaccaucaucgcccugagcuacauccugugccugguguucgcccagaagcugcccggccacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccaagggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165037 - RNA, 1701 nt, Artificial Sequence; identical to SEQ ID NO: 159502
  derived and/or modified sequence opt4 from hemagglutinin__InfluenzaA__AIJ10730

SEQ ID NO: 165038 - RNA, 1701 nt, Artificial Sequence; identical to SEQ ID NO: 159502
  derived and/or modified sequence opt4 from hemagglutinin__InfluenzaA__AIJ10731

SEQ ID NO: 165039 - RNA, 1701 nt, Artificial Sequence
  derived and/or modified sequence opt4 from hemagglutinin__InfluenzaA__AIJ10732
augaagaccaucaucgcccugagcuacauccugugccugguguucgcccaggagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucagauaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165040 - RNA, 1701 nt, Artificial Sequence
  derived and/or modified sequence opt4 from hemagglutinin__InfluenzaA__AIJ10733
augaagaccaucaucgcccugagcuacauccugugccugguguucgcccaggagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucagauaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165041 - RNA, 1701 nt, Artificial Sequence
  derived and/or modified sequence opt4 from hemagglutinin__InfluenzaA__AIJ10734
augaagaccaucaucgcccugagcuacauccugugccugguguucgcccagaagcugcccgagaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcaccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165042 - RNA, 1701 nt, Artificial Sequence
  derived and/or modified sequence opt4 from hemagglutinin__InfluenzaA__AIJ10735
augaagaccaucaucgcccugagcuacauccugugccugaucuucgcccagaagcugcccgagaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcaccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaagggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165043 - RNA, 1701 nt, Artificial Sequence
  derived and/or modified sequence opt4 from hemagglutinin__InfluenzaA__AIJ10736
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcaccaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165044 - RNA, 1701 nt, Artificial Sequence
  derived and/or modified sequence opt4 from hemagglutinin__InfluenzaA__AIJ10737
augaagaccaucaucgcccugagcuacauccugugccuggugguggcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165045 - RNA, 1701 nt, Artificial Sequence
  derived and/or modified sequence opt4 from hemagglutinin__InfluenzaA__AIJ10738
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcacuucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165046 - RNA, 1701 nt, Artificial Sequence; identical to SEQ ID NO: 161973
  derived and/or modified sequence opt4 from hemagglutinin__InfluenzaA__AIJ10740

SEQ ID NO: 165047 - RNA, 1701 nt, Artificial Sequence; identical to SEQ ID NO: 161973
  derived and/or modified sequence opt4 from hemagglutinin__InfluenzaA__AIJ10741

SEQ ID NO: 165048 - RNA, 1701 nt, Artificial Sequence
  derived and/or modified sequence opt4 from hemagglutinin__InfluenzaA__AIJ10742
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccguggccaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165049 - RNA, 1701 nt, Artificial Sequence
  derived and/or modified sequence opt4 from hemagglutinin__InfluenzaA__AIJ10743
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaucaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165050 - RNA, 1701 nt, Artificial Sequence
  derived and/or modified sequence opt4 from hemagglutinin__InfluenzaA__AIJ10744
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagaacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165051 - RNA, 1701 nt, Artificial Sequence; identical to SEQ ID NO: 162514
  derived and/or modified sequence opt4 from hemagglutinin__InfluenzaA__AIJ10745

SEQ ID NO: 165052 - RNA, 1701 nt, Artificial Sequence
  derived and/or modified sequence opt4 from hemagglutinin__InfluenzaA__AIJ10747
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacgacuuccagaacaagaagugggaccuguucguggagagaagcaaggccuacagcaacugcuaccccuacgacgugcccgacuacgccagccugagaagccugguggccagcagcggcacccuggaguucaacaacgagaacuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165053 - RNA, 1701 nt, Artificial Sequence; identical to SEQ ID NO: 165052
  derived and/or modified sequence opt4 from hemagglutinin__InfluenzaA__AIJ10748

SEQ ID NO: 165054 - RNA, 1701 nt, Artificial Sequence
  derived and/or modified sequence opt4 from hemagglutinin__InfluenzaA__AIJ10750
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaucagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165055 - RNA, 1701 nt, Artificial Sequence
  derived and/or modified sequence opt4 from hemagglutinin__InfluenzaA__AIJ10752
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaugagcugcuuccugcugugcguggcccugcugggcuucaucaugugggccugccagaagggcaacaucagaugcaacaucugcaucuga

SEQ ID NO: 165056 - RNA, 1701 nt, Artificial Sequence
  derived and/or modified sequence opt4 from hemagglutinin__InfluenzaA__AIJ10753
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcagcugcaucagaggcagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165057 - RNA, 1701 nt, Artificial Sequence; identical to SEQ ID NO: 162514
  derived and/or modified sequence opt4 from hemagglutinin__InfluenzaA__AIJ10754

SEQ ID NO: 165058 - RNA, 1701 nt, Artificial Sequence
  derived and/or modified sequence opt4 from hemagglutinin__InfluenzaA__AIJ10755
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccagagcgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165059 - RNA, 1701 nt, Artificial Sequence; identical to SEQ ID NO: 162514
  derived and/or modified sequence opt4 from hemagglutinin__InfluenzaA__AIJ10756

SEQ ID NO: 165060 - RNA, 1701 nt, Artificial Sequence
  derived and/or modified sequence opt4 from hemagglutinin__InfluenzaA__AIJ10757
augaagaccaucaucgcccugagcuacauccugugccuggugaucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 165061 - RNA, 1701 nt, Artificial Sequence
  derived and/or modified sequence opt4 from hemagglutinin__InfluenzaA__AIJ10758
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165062 - RNA, 1701 nt, Artificial Sequence; identical to SEQ ID NO: 162514
  derived and/or modified sequence opt4 from hemagglutinin__InfluenzaA__AIJ10759

SEQ ID NO: 165063 - RNA, 1701 nt, Artificial Sequence
  derived and/or modified sequence opt4 from hemagglutinin__InfluenzaA__AIJ10760
augaagaccaucaucgcccugagcuacauccugugccuggugaucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165064 - RNA, 1701 nt, Artificial Sequence
  derived and/or modified sequence opt4 from hemagglutinin__InfluenzaA__AIJ10761
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagaaacgaggcccugaacaagagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 165065 - RNA, 1701 nt, Artificial Sequence; identical to SEQ ID NO: 164412
  derived and/or modified sequence opt4 from hemagglutinin__InfluenzaA__AIJ10762

SEQ ID NO: 165066 - RNA, 1701 nt, Artificial Sequence; identical to SEQ ID NO: 164412
  derived and/or modified sequence opt4 from hemagglutinin__InfluenzaA__AIJ10763

SEQ ID NO: 165067 - RNA, 1701 nt, Artificial Sequence; identical to SEQ ID NO: 164412
  derived and/or modified sequence opt4 from hemagglutinin__InfluenzaA__AIJ10764

SEQ ID NO: 165068 - RNA, 1701 nt, Artificial Sequence; identical to SEQ ID NO: 164412
  derived and/or modified sequence opt4 from hemagglutinin__InfluenzaA__AIJ10765

SEQ ID NO: 165069 - RNA, 1701 nt, Artificial Sequence; identical to SEQ ID NO: 164412
  derived and/or modified sequence opt4 from hemagglutinin__InfluenzaA__AIJ10766

SEQ ID NO: 165070 - RNA, 1701 nt, Artificial Sequence; identical to SEQ ID NO: 164412
  derived and/or modified sequence opt4 from hemagglutinin__InfluenzaA__AIJ10767

SEQ ID NO: 165071 - RNA, 1701 nt, Artificial Sequence
  derived and/or modified sequence opt4 from hemagglutinin__InfluenzaA__AIJ10768
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacauccccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 165072 - RNA, 1701 nt, Artificial Sequence
  derived and/or modified sequence opt4 from hemagglutinin__InfluenzaA__AIJ10769
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 165073 - RNA, 1701 nt, Artificial Sequence; identical to SEQ ID NO: 164412
  derived and/or modified sequence opt4 from hemagglutinin__InfluenzaA__AIJ10770

SEQ ID NO: 165074 - RNA, 1701 nt, Artificial Sequence; identical to SEQ ID NO: 164412
  derived and/or modified sequence opt4 from hemagglutinin__InfluenzaA__AIJ10771

SEQ ID NO: 165075 - RNA, 1701 nt, Artificial Sequence; identical to SEQ ID NO: 164412
  derived and/or modified sequence opt4 from hemagglutinin__InfluenzaA__AIJ10772

SEQ ID NO: 165076 - RNA, 1701 nt, Artificial Sequence; identical to SEQ ID NO: 164412
  derived and/or modified sequence opt4 from hemagglutinin__InfluenzaA__AIJ10773

SEQ ID NO: 165077 - RNA, 1701 nt, Artificial Sequence
  derived and/or modified sequence opt4 from hemagglutinin__InfluenzaA__AIJ10774
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccagagcgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 165078 - RNA, 1701 nt, Artificial Sequence
  derived and/or modified sequence opt4 from hemagglutinin__InfluenzaA__AIJ10776
augaagaccaucaucgcccugagcugcauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugagcaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 165079 - RNA, 1701 nt, Artificial Sequence; identical to SEQ ID NO: 164412
  derived and/or modified sequence opt4 from hemagglutinin__InfluenzaA__AIJ10777

SEQ ID NO: 165080 - RNA, 1701 nt, Artificial Sequence; identical to SEQ ID NO: 164412
  derived and/or modified sequence opt4 from hemagglutinin__InfluenzaA__AIJ10778

SEQ ID NO: 165081 - RNA, 1701 nt, Artificial Sequence
  derived and/or modified sequence opt4 from hemagglutinin__InfluenzaA__AIJ10780
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacagcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggacaucgagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165082 - RNA, 1701 nt, Artificial Sequence; identical to SEQ ID NO: 164412
  derived and/or modified sequence opt4 from hemagglutinin__InfluenzaA__AIJ10781

SEQ ID NO: 165083 - RNA, 1701 nt, Artificial Sequence; identical to SEQ ID NO: 164412
  derived and/or modified sequence opt4 from hemagglutinin__InfluenzaA__AIJ10782

SEQ ID NO: 165084 - RNA, 1701 nt, Artificial Sequence
  derived and/or modified sequence opt4 from hemagglutinin__InfluenzaA__AIJ10783
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggugggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165085 - RNA, 1701 nt, Artificial Sequence; identical to SEQ ID NO: 165084
  derived and/or modified sequence opt4 from hemagglutinin__InfluenzaA__AIJ10784

SEQ ID NO: 165086 - RNA, 1701 nt, Artificial Sequence
  derived and/or modified sequence opt4 from hemagglutinin__InfluenzaA__AIJ10785
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccagagcgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165087 - RNA, 1701 nt, Artificial Sequence; identical to SEQ ID NO: 165084
  derived and/or modified sequence opt4 from hemagglutinin__InfluenzaA__AIJ10786

SEQ ID NO: 165088 - RNA, 1701 nt, Artificial Sequence
  derived and/or modified sequence opt4 from hemagglutinin__InfluenzaA__AIJ10787
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggugggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauucagaaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165089 - RNA, 1701 nt, Artificial Sequence; identical to SEQ ID NO: 165086
  derived and/or modified sequence opt4 from hemagglutinin__InfluenzaA__AIJ10788

SEQ ID NO: 165090 - RNA, 1701 nt, Artificial Sequence; identical to SEQ ID NO: 165086
  derived and/or modified sequence opt4 from hemagglutinin__InfluenzaA__AIJ10789

SEQ ID NO: 165091 - RNA, 1701 nt, Artificial Sequence; identical to SEQ ID NO: 165084
  derived and/or modified sequence opt4 from hemagglutinin__InfluenzaA__AIJ10790

SEQ ID NO: 165092 - RNA, 1701 nt, Artificial Sequence; identical to SEQ ID NO: 164412
  derived and/or modified sequence opt4 from hemagglutinin__InfluenzaA__AIJ10791

SEQ ID NO: 165093 - RNA, 1701 nt, Artificial Sequence
  derived and/or modified sequence opt4 from hemagglutinin__InfluenzaA__AIJ10792
augaagaccaucaucgcccugagcuacauccugugccugguguucgcccagaagcugcccggcgacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 165094 - RNA, 1701 nt, Artificial Sequence; identical to SEQ ID NO: 162403
  derived and/or modified sequence opt4 from hemagglutinin__InfluenzaA__AIJ29347

SEQ ID NO: 165095 - RNA, 1701 nt, Artificial Sequence
  derived and/or modified sequence opt4 from hemagglutinin__InfluenzaA__AIJ29349
augaagaccaucaucgcccugagcuacauccugugccugguguucgcccagaaguuccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165096 - RNA, 1701 nt, Artificial Sequence
  derived and/or modified sequence opt4 from hemagglutinin__InfluenzaA__AIJ29351
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugccugcugcugugcguggcccugcugggcuucaucaugugggccugccagaagggcaacaucagaugcaacaucugcaucuga

SEQ ID NO: 165097 - RNA, 1701 nt, Artificial Sequence; identical to SEQ ID NO: 162000
  derived and/or modified sequence opt4 from hemagglutinin__InfluenzaA__AIJ29353

SEQ ID NO: 165098 - RNA, 1701 nt, Artificial Sequence
  derived and/or modified sequence opt4 from hemagglutinin__InfluenzaA__AIJ29355
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagaagcagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165099 - RNA, 1701 nt, Artificial Sequence; identical to SEQ ID NO: 161594
  derived and/or modified sequence opt4 from hemagglutinin__InfluenzaA__AIJ29357

SEQ ID NO: 165100 - RNA, 1701 nt, Artificial Sequence
  derived and/or modified sequence opt4 from hemagglutinin__InfluenzaA__AIJ29359
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggccaucaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165101 - RNA, 1701 nt, Artificial Sequence
  derived and/or modified sequence opt4 from hemagglutinin__InfluenzaA__AIJ29361
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgugagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165102 - RNA, 1701 nt, Artificial Sequence; identical to SEQ ID NO: 162560
  derived and/or modified sequence opt4 from hemagglutinin__InfluenzaA__AIL93623

SEQ ID NO: 165103 - RNA, 1701 nt, Artificial Sequence
  derived and/or modified sequence opt4 from hemagglutinin__InfluenzaA__AIL93634
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcaacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165104 - RNA, 1701 nt, Artificial Sequence
  derived and/or modified sequence opt4 from hemagglutinin__InfluenzaA__AIL93645
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucagauaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165105 - RNA, 1701 nt, Artificial Sequence; identical to SEQ ID NO: 162514
  derived and/or modified sequence opt4 from hemagglutinin__InfluenzaA__AIL93657

SEQ ID NO: 165106 - RNA, 1701 nt, Artificial Sequence; identical to SEQ ID NO: 162514
  derived and/or modified sequence opt4 from hemagglutinin__InfluenzaA__AIL93669

SEQ ID NO: 165107 - RNA, 1701 nt, Artificial Sequence
  derived and/or modified sequence opt4 from hemagglutinin__InfluenzaA__AIL93681
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaagcgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165108 - RNA, 1701 nt, Artificial Sequence; identical to SEQ ID NO: 165104
  derived and/or modified sequence opt4 from hemagglutinin__InfluenzaA__AIL93692

SEQ ID NO: 165109 - RNA, 1701 nt, Artificial Sequence; identical to SEQ ID NO: 165104
  derived and/or modified sequence opt4 from hemagglutinin__InfluenzaA__AIL93716

SEQ ID NO: 165110 - RNA, 1701 nt, Artificial Sequence; identical to SEQ ID NO: 162514
  derived and/or modified sequence opt4 from hemagglutinin__InfluenzaA__AIL93728

SEQ ID NO: 165111 - RNA, 1701 nt, Artificial Sequence; identical to SEQ ID NO: 162514
  derived and/or modified sequence opt4 from hemagglutinin__InfluenzaA__AIL93740

SEQ ID NO: 165112 - RNA, 1701 nt, Artificial Sequence
  derived and/or modified sequence opt4 from hemagglutinin__InfluenzaA__AIL93752
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagaccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagaagagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165113 - RNA, 1701 nt, Artificial Sequence
  derived and/or modified sequence opt4 from hemagglutinin__InfluenzaA__AIL93764
augaagaccaucaucgcccugagcuacauccugugccugguguucacccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacgagaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165114 - RNA, 1701 nt, Artificial Sequence; identical to SEQ ID NO: 162514
  derived and/or modified sequence opt4 from hemagglutinin__InfluenzaA__AIL93776

SEQ ID NO: 165115 - RNA, 1701 nt, Artificial Sequence; identical to SEQ ID NO: 162514
  derived and/or modified sequence opt4 from hemagglutinin__InfluenzaA__AIL93788

SEQ ID NO: 165116 - RNA, 1701 nt, Artificial Sequence; identical to SEQ ID NO: 162514
  derived and/or modified sequence opt4 from hemagglutinin__InfluenzaA__AIL93812

SEQ ID NO: 165117 - RNA, 1701 nt, Artificial Sequence; identical to SEQ ID NO: 162514
  derived and/or modified sequence opt4 from hemagglutinin__InfluenzaA__AIL93824

SEQ ID NO: 165118 - RNA, 1701 nt, Artificial Sequence; identical to SEQ ID NO: 165107
  derived and/or modified sequence opt4 from hemagglutinin__InfluenzaA__AIL93836

SEQ ID NO: 165119 - RNA, 1701 nt, Artificial Sequence
  derived and/or modified sequence opt4 from hemagglutinin__InfluenzaA__AIL93847
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaagcgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucugcuucuggaugugcagcaacggcagccugcagugcagaaucugcaucuga

SEQ ID NO: 165120 - RNA, 1701 nt, Artificial Sequence; identical to SEQ ID NO: 165104
  derived and/or modified sequence opt4 from hemagglutinin__InfluenzaA__AIL93858

SEQ ID NO: 165121 - RNA, 1701 nt, Artificial Sequence; identical to SEQ ID NO: 162514
  derived and/or modified sequence opt4 from hemagglutinin__InfluenzaA__AIL93870

SEQ ID NO: 165122 - RNA, 1701 nt, Artificial Sequence
  derived and/or modified sequence opt4 from hemagglutinin__InfluenzaA__AIL93882
augaagaccaucaucgcccugagcuacauccugugccugguguucgcccagaagccccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165123 - RNA, 1701 nt, Artificial Sequence; identical to SEQ ID NO: 162514
  derived and/or modified sequence opt4 from hemagglutinin__InfluenzaA__AIL93894
